United States Patent 11,446,398 (REGULATED BIOCIRCUIT SYSTEMS) - sequence listing, part 46

SEQ ID NO: 135656 - DNA, 1629 bp, Homo sapiens
  Payload ID: 6520
  Gene Symbol: FGD4
  Gene Name: FYVE, RhoGEF and PH domain containing 4
  ENST ID: ENST00000472289
  CDS Start-End: 542-1165
ggagcacaaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccactagtaaatgttacttttaaggacatgaatatggaagtattaaattattcaacagattataa

SEQ ID NO: 135657 - DNA, 2987 bp, Homo sapiens
  Payload ID: 6520
  Gene Symbol: FGD4
  Gene Name: FYVE, RhoGEF and PH domain containing 4
  ENST ID: ENST00000493087
  CDS Start-End: 451-1158
atctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaaacctttctcattacagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgca

SEQ ID NO: 135658 - DNA, 3503 bp, Homo sapiens
  Payload ID: 6520
  Gene Symbol: FGD4
  Gene Name: FYVE, RhoGEF and PH domain containing 4
  ENST ID: ENST00000546442
  CDS Start-End: 496-2517
ggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaa

SEQ ID NO: 135659 - DNA, 2977 bp, Homo sapiens
  Payload ID: 6520
  Gene Symbol: FGD4
  Gene Name: FYVE, RhoGEF and PH domain containing 4
  ENST ID: ENST00000534526
  CDS Start-End: 266-2977
ggtagcggctttgagtgagtgcgggagctgcagataccgagacgctgcgactgccgcaggagtcgccgcagccaaactcgccgcgacgccgggagggagcgtaccgggaaggagagggagaggaggcactcgctgaggagacgccgcagtagagggcgcccccggagtcgcgccgaacctgggcatgcaggcgacgccccccaggggccgctcgcggctggacgggagcgggaggagtcggggagcggcggtcgagcccggcaggatgagcgacgagggcggctccaacttcaggcgggtggcgatccggcggaagtccaacccctcctacctgccgcccggggtgccccggccctggagcaggcccgcgtcgcacctgggacgtgtagggaccgctgccttcaagggccaggtgccctcaggagccacaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctga

SEQ ID NO: 135660 - DNA, 2435 bp, Homo sapiens
  Payload ID: 6520
  Gene Symbol: FGD4
  Gene Name: FYVE, RhoGEF and PH domain containing 4
  ENST ID: ENST00000551984
  CDS Start-End: 428-550
gtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactgga

SEQ ID NO: 135661 - DNA, 580 bp, Homo sapiens
  Payload ID: 6520
  Gene Symbol: FGD4
  Gene Name: FYVE, RhoGEF and PH domain containing 4
  ENST ID: ENST00000583694
  CDS Start-End: 490-580
tatctgcaatggaccgggttaatgggaggcttgctttggctcgctggaagaacaaatgaagggagttttacttcaaccatttgtgacttctggccaagaggaataaattcagcttttataagatggagtctcactctgtcacctaggctggtgtgcagtggcacagtcttggctcactgcaacctccgcctcccggattcaagcaattctcccacctcagtctcctgagtagctgagattacaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggca

SEQ ID NO: 135662 - DNA, 5720 bp, Homo sapiens
  Payload ID: 6521
  Gene Symbol: FGD5
  Gene Name: FYVE, RhoGEF and PH domain containing 5
  Uniprot ID: Q6ZNL6
  ENST ID: ENST00000285046
  CDS Start-End: 111-4499
caaaaccacctgtcgctcccaagccaaagactaccagtccactgacgccagtgaccgcgcccaaattcccttcctcagccaggcccgagagtcttcacagtccaaactccatgttcaggggtccgaagccccccattgcccccaagcccaggctgactgccccaaacgagtggagagccagtgtgtacctgaatgacagcttgaacaaatgcagcaacgggcggctgccctgtgtagacagggggcttgatgaggggccccggtccatcccaaagtgctctgagtcggagaccgacgaggattacatcgtggtccccagggttccgctgagggaggatgaacccaaggacgagggcagtgtggggaacaaagccctggtgtctcccgagtcctctgcggaagaggaagaggagcgtgaagagggaggcgaggcatgtggcctggagggtacaggagctggtgaggattcagtggcccctgctgctccgggtgcaggagcgctgagcagggagggtgaggaaggcacagaccttgctcttgaggatgaaggggagggctgcgctgatgagccagggacactggagcaggtgtccagaagtgaggaggaagagaagctagtgcagccacacagggagtgcagcctggaggacagtgggccttgggctggagagggggtcttccagagcgacctcctcctgcctcacatccatggagaggaccaggagccccccgacacccccggggaggcagaggaggatgatgaggaaggctgtgccagcacagacccagcaggggcagatgagggttcgggtcctgacaggcccacggaggacatgggacaggatgctgaggacaccagtgaggagccccctgagaaggaggagctggccggggtccaggaggcagagacagccacagactgccctgaagttcttgaggagggatgtgaagaggccacgggtgtcacaggtggggaacaggttgacctcagtgaaccacctgaccacgagaagaaaaccaaccaagaagtggcagccgccaccctggaggaccatgcacaggatgagtccgccgaggagagctgccagattgtcccttttgagaatgactgcatggaggacttcgtgacttccctcacaggaagcccctatgagttcttcccaactgagagcacctctttttgcagcgagagctgttctcctctttctgaatcagcgaaaggtttagaatcagagcaggcaccaaagctggggctgcgtgcggaggagaaccccatggtgggggctttgtgtggccagtgtggctccctacagggtggagcggccgagggtcccgcagcccctgatgtggtggtcgtgctggaggaggaggccttggatgatgcactggccaacccctatgtgatgggagtgggcctgcccggtcaggcggcccctggagaaggagggcaggctgcatcggacgccctgggtggttatggctcgaaagaagaattgaactgtgaggcagagggtggcctggttcccgcggacaggaagaacaccagcacgagggtccggccccactctgggaaggtggccggctatgtcccagaaaccgtccctgaagaaaccggacctgaggcgggctcgtcagcccctggcattggaggtgccgcagaggaggtgggaaagacgcttttgtcattggaggggaagcccttggaagccagcagggccttgccagcaaagcccagggcctttactttataccctcggtcgttctccgtggaaggccgagagattccagtgtccgtgtaccaggagcctgaggggtcagggttggatgaccacaggataaagaggaaagaggacaatctctctctgtcgtgtgtaattggctcctctgggagtttctcccagagaaaccaccttccgtccagcggcacctccacgccttcttccatggtcgacatcccacctcctttcgacctggcctgcatcaccaagaagcccatcacaaagagctctccctcactcctgatcgagagcgactccccggacaagtacaagaagaagaagtcatcctttaagcgcttcctggcactgacgtttaagaagaagacggagaacaaattgcatgtggatgtgaacgtgtcttcctctaggtcctcttcagagtccagctaccacgggccttccaggattctggaagttgaccggagaagcctcagcaactcccctcagcttaagtctcggactgggaagctccgggcttctgaatccccctcctccctcatcttttatagagatggcaagaggaaaggtgtccccttcagcaggacggtgtccagagtggagtcctttgaagaccgctcccggccgcccttcctgcccttgccactgaccaagccacggtccatctccttccccagcgctgacacttcagactatgagaacattccagccatgaactcggactatgagaatatccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagagcggcctgtgagcatgagcttcccgctgtcttcaccccgcttctcgggcagtgccttttcatccgtcttccagagcattaacccctcgaccttcaagaagcagaagaaagtcccttcagccctgacagaggtggctgcctctggagagggctctgccatcagtggctatctcagccggtgtaagaggggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgat

SEQ ID NO: 135663 - DNA, 755 bp, Homo sapiens
  Payload ID: 6521
  Gene Symbol: FGD5
  Gene Name: FYVE, RhoGEF and PH domain containing 5
  ENST ID: ENST00000457774
  CDS Start-End: 1-755
ccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagg

SEQ ID NO: 135664 - DNA, 5768 bp, Homo sapiens
  Payload ID: 6521
  Gene Symbol: FGD5
  Gene Name: FYVE, RhoGEF and PH domain containing 5
  ENST ID: ENST00000543601
  CDS Start-End: 834-4370
caaaaccacctgtcgctcccaagccaaagactaccagtccactgacgccagtgaccgcgcccaaattcccttcctcagccaggcccgagagtcttcacagtccaaactccatgttcaggggtccgaagccccccattgcccccaagcccaggctgactgccccaaacgagtggagagccagtgtgtacctgaatgacagcttgaacaaatgcagcaacgggcggctgccctgtgtagacagggggcttgatgaggggccccggtccatcccaaagtgctctgagtcggagaccgacgaggattacatcgtggtccccagggttccgctgagggaggatgaacccaaggacgagggcagtgtggggaacaaagccctggtgtctcccgagtcctctgcggaagaggaagaggagcgtgaagagggaggcgaggcatgtggcctggagggtacaggagctggtgaggattcagtggcccctgctgctccgggtgcaggagcgctgagcagggagggtgaggaaggcacagaccttgctcttgaggatgaaggggagggctgcgctgatgagccagggacactggagcaggtgtccagaagtgaggaggaagagaagctagtgcagccacacagggagtgcagcctggaggacagtgggccttgggctggagagggggtcttccagagcgacctcctcctgcctcacatccatggagaggaccaggagccccccgacacccccggggaggcagaggaggatgatgaggaaggctgtgccagcacagacccagcaggggcagatgagggttcgggtcctgacaggcccacggaggacatgggacaggatgctgaggacaccagtgaggagccccctgagaaggaggagctggccggggtccaggaggcagagacagccacagactgccctgaagttcttgaggagggatgtgaagaggccacgggtgtcacaggtggggaacaggttgacctcagtgaaccacctgaccacgagaagaaaaccaaccaagaagtggcagccgccaccctggaggaccatgcacaggatgagtccgccgaggagagctgccagattgtcccttttgagaatgactgcatggaggacttcgtgacttccctcacaggaagcccctatgagttcttcccaactgagagcacctctttttgcagcgagagctgttctcctctttctgaatcagcgaaaggtttagaatcagagcaggcaccaaagctggggctgcgtgcggaggagaaccccatggtgggggctttgtgtggccagtgtggctccctacagggtggagcggccgagggtcccgcagcccctgatgtggtggtcgtgctggaggaggaggccttggatgatgcactggccaacccctatgtgatgggagtgggcctgcccggtcaggcggcccctggagaaggagggcaggctgcatcggacgccctgggtggttatggctcgaaagaagaattgaactgtgaggcagagggtggcctggttcccgcggacaggaagaacaccagcacgagggtccggccccactctgggaaggtggccggctatgtcccagaaaccgtccctgaagaaaccggacctgaggcgggctcgtcagcccctggcattggaggtgccgcagaggaggtgggaaagacgcttttgtcattggaggggaagcccttggaagccagcagggccttgccagcaaagcccagggcctttactttataccctcggtcgttctccgtggaaggccgagagattccagtgtccgtgtaccaggagcctgaggggtcagggttggatgaccacaggataaagaggaaagaggacaatctctctctgtcgtgtgtaattggctcctctgggagtttctcccagagaaaccaccttccgtccagcggcacctccacgccttcttccatggtcgacatcccacctcctttcgacctggcctgcatcaccaagaagcccatcacaaagagctctccctcactcctgatcgagagcgactccccggacaagtacaagaagaagaagtcatcctttaagcgcttcctggcactgacgtttaagaagaagacggagaacaaattgcatgtggatgtgaacgtgtcttcctctaggtcctcttcagagtccagctaccacgggccttccaggattctggaagttgaccggagaagcctcagcaactcccctcagcttaagtctcggactgggaagctccgggcttctgaatccccctcctccctcatcttttatagagatggcaagaggaaaggtgtccccttcagcaggacggtgtccagagtggagtcctttgaagaccgctcccggccgcccttcctgcccttgccactgaccaagccacggtccatctccttccccagcgctgacacttcagactatgagaacattccagccatgaactcggactatgagaatatccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagagcggcctgtgagcatgagcttcccgctgtcttcaccccgcttctcgggcagtgccttttcatccgtcttccagagcattaacccctcgaccttcaagaagcagaagaaagtcccttcagccctgacagaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttca

SEQ ID NO: 135665 - DNA, 9288 bp, Homo sapiens
  Payload ID: 6522
  Gene Symbol: FGD6
  Gene Name: FYVE, RhoGEF and PH domain containing 6
  Uniprot ID: Q6ZV73
  ENST ID: ENST00000343958
  CDS Start-End: 225-4517
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaacaatcttactggtggaaagtctttgtaaggaaaaaacacatagcaaggagcaaatttccacaaagtgcttggtttaggaattgtgattattataaaactgctgatgaaaaaaatgcatgtctttgaatcaataaacttgggtgaatatttgtatcttttagtggaaaaacatggccagcttctacctcagtaactgtgaactgaaatttcagtaaattatctaaagtatttctgttgttaggtacctctttggcaggagttaatattacatcatcaaagaattatagcaaagagatagaatctgaattttttaaaactgtgagtaggaatgaagatgtttttatttgcagaataccacaaataaccaactcttccggcttttaagtccaatcttttaaaaaatctaccacttcgaaacaaacataaatgtatcattttttaaaatagcaaaatatagcaagcattatgtcacataatattccctgctattataagagttctgagcccaagtcaatgatgatatttgtatctataagtaatgttacatttccaaaaatattgtgcattacaaatggaactggaattactatatcagaaaagcataattataagccagtaataactgaaattctatagtattcattttcaaaaggtctttttctgccagtttgtgatatcctccctcctaattaaaaaaaaaaacaacaaatcctttctctataagcagctatcagcacacctccttaggaaagatttagattcataattctggtgcacttactgtttaacatatgaactaccttgcacatacaattgttgattagcagaagaaaatgaaataacactgtgataaaagccatccctgatgttcacaatacacaatttattaactaagtttaaactataaattatcttaactgccatgagcggtggctcacacctacaatctcagcattttgggaggccgaggccgttggaccacctgaggtcaggagatcgagaccagcctggccaatatggtgaaaccccatctctattaaaaatacaagaattagccggtcgtggtggtacatggctgtagtcctagctattcagcaggctgaggcaggagcatcgcttgaacccaggaggcagaggttgcagtgagccgagatggtgccactgcactccagcctgggatgacagagcgagactccatctcaaaaaaaaaaaaaaaaaaaaaattgaacagcaaggttatccatataatatttctttaaagggtacaagaattttcctttctgcctctaaataaaggatttcctaattcagtgtgatccttaacagcaaccatgaggattactgagtgcctttctggggccttttgaatgctgtttggtacagcaccagagtccctactagatctagagttggctgctatagttttttgtggcgattttttgccatggagtcatttgaacctcatacacaatcctaacatgccatcccctttctgtcatagcaggtacactaaaatttctttgtagctcaattttatataatcaagatcacataaataaggcttccatgttagaatcgttgcagtttttagtgtattcctttttggaggctaaagttgtaccttataaactgtttctgcgtctggcatttagcaagacaagttatttgggttttctttccctcctcttgagctctcagccttctgactacaaggtttggcttaagccttataatctaaaaaatatcagccaggctattctatcttctaagacctggctgaatcatgagccagttctaaatctaaagagagtgagagagggaagaaatctggcacaaacttacagtctctttaattacatgtaaaatgcatgtgactgtattacctattggcttagccccatggagggtttagaaaaatgtgtagtctttgtggaagctatccaattatccttctcccaaaaagatgttttaaatgtggaatagtattacattcccctgcccctttatgagtccttcataacttactaaagctgaccaattgttatttatgtaacctggctcattcattgtcaactaagaacctaattatatgcaatttattgtaaaaaaagctataaaaatatattttgctagtattttagaggaaaaatgatattgggcacagtctataaatggggagaaaagttaagtagtatctagattccaaggatactatatttattatacagatatgtgtgcctgtgcttccatcaaaccctttttcaggtatctccttttaattcataaggaggaaagagtagggcatttataaagctaagctaaaaatgatgctaagcataacgtagatgagacgccaggctgaaccaggggaaggctggcattgttagtgtccccaactagcagtccacctttatctgtggcagctataaatgtacaggacccatcagagtcctaagaaaatgagagtaattatctctggcatcatccacatttccgactctttccaatctcttttccctttttctgtaatgtacccagcatccccctattgtattttggttgcccaagattcttgattctttgagtgtgtagtagcatttcttaaaatgagatcatcagaccaacccttgattcacatgaaagctgtaatgacacaacaaagagaaggcgacagttttaaagtataattgtcagccaaatgtgtattttatatttggttcatagaatatatctagatgtggggaaagtctcctatttggtaatttagttaaaatgtaaatgttatatcacagcatatgttggtatgttttggagtgtgcttccattgtgctcagcttttgaaaagtttgaaatccactttagtcaaatgtagtcaatgggatttccagagatacatattgtttttcttagtgtaccacacactccttgaaggcagatactgtacttaatatatcactgtcttccataatactgccctaggtctttttagtttttaagagaccgggtctcgctatgtttcccatgctgaactcaaatgcctgggcttaagcaatcctcccacctcagcctctggagtagctgggactacaggggcatgcaccaccaggcctggcttcctaggagggtctttaaagagaaaatatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatgaataaaactcaacttccttcccattcaaatctgtttattttcttctgtaagagaaagataccatttgagactccagaatctgcctctaactctcaacaagactctgcaattactcaagtatcctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacttttacatgcctcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatatatactttataaataaaaaaattagcattgtaaataatgttaatatgtatttatacaaaataaatttactataatata

SEQ ID NO: 135666 - DNA, 2232 bp, Homo sapiens
  Payload ID: 6522
  Gene Symbol: FGD6
  Gene Name: FYVE, RhoGEF and PH domain containing 6
  ENST ID: ENST00000451107
  CDS Start-End: 243-422
gctctgcggggcggtgctagtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttca

SEQ ID NO: 135667 - DNA, 725 bp, Homo sapiens
  Payload ID: 6522
  Gene Symbol: FGD6
  Gene Name: FYVE, RhoGEF and PH domain containing 6
  ENST ID: ENST00000548069
  CDS Start-End: 1-401
ctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaa

SEQ ID NO: 135668 - DNA, 3757 bp, Homo sapiens
  Payload ID: 6522
  Gene Symbol: FGD6
  Gene Name: FYVE, RhoGEF and PH domain containing 6
  ENST ID: ENST00000549499
  CDS Start-End: 140-3757
aggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaa

SEQ ID NO: 135669 - DNA, 904 bp, Homo sapiens
  Payload ID: 6522
  Gene Symbol: FGD6
  Gene Name: FYVE, RhoGEF and PH domain containing 6
  ENST ID: ENST00000551521
  CDS Start-End: 67-904
agttactggggcagctactggtttcctgttcctcccatctgactcagggtgatcagtcacattcttatgctgcagttaaggccccaggtgattcttaactgtttaaggagatccaggccctgctctctttgccaagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattag

SEQ ID NO: 135670 - DNA, 4568 bp, Homo sapiens
  Payload ID: 6522
  Gene Symbol: FGD6
  Gene Name: FYVE, RhoGEF and PH domain containing 6
  Uniprot ID: Q6ZV73
  ENST ID: ENST00000546711
  CDS Start-End: 225-4349
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtaagatctgaaatctaaagatgagtaatttggggttttgtaatgccaactgcaagtaattacaatattttaaaaatccatttattttacataagattttttgctttgcttttggatgggggaggtgttgttgctgttatttttaatgtgaacagtgttcttgctttgtacctggagagctctttctcaaatgtgttaggaattttccatattattaaaatgcaatttttgtgtgtg

SEQ ID NO: 135671 - DNA, 768 bp, Homo sapiens
  Payload ID: 6523
  Gene Symbol: GAGE1
  Gene Name: G antigen 1
  Uniprot ID: Q13068
  ENST ID: ENST00000381700
  CDS Start-End: 75-428
agctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaagggcaatcacagtgttaaaagaagacatgctgaaatgttgcaggctgctcctatgttggaaaattcttcattgaagttctcccaataaagctttacagccttctgcaaagaagtcttgtgaatcttttgtcaattttatttctagctatttgatgctgtgaaatgtttcattctttgcaattttgtattctatctccttgagctgtgtgtagaggcataattctcatgtattgattttctatccagcaaccttgttaaatatgcttatgaattttaaaagtttacttctaggttttttcagttttcaacctacagaatcatatcatttttgaataagaacaattttgtttctgccttt

SEQ ID NO: 135672 - DNA, 3129 bp, Homo sapiens
  Payload ID: 6523
  Gene Symbol: GAGE1
  Gene Name: G antigen 1
  Uniprot ID: Q13065
  ENST ID: ENST00000381709
  CDS Start-End: 112-531
ctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactatgttgcccagactgggattctctggcttttaatgaacaattgcttcttaaatctttccccacggaaaccttgagtgactgaaatatcaaatggcaagagaccgtttagttcctatcatctgtggcatgtgaagggcaatcacagtgttaaaagaagacatgctgaaatgttgcaggctgctcctatgttggaaaattcttcattgaagttctcccaataaagctttacagccttctgcaaagaagtcttgtgaatcttttgtcaattttatttctagctatttgatgctgtgaaatgtttcattctttgcaattttgtattctatctccttgagctgtgtgtagaggcataattctcatgtattgattttctatccagcaaccttgttaaatatgcttatgaattttaaaagtttacttctaggttttttcagttttcaacctacagaatcatatcatttttgaataagaacaattttgtttctgccttttttgtttgttttttcttttgtatttttcgtagaggtgggattttggcctgtgtcctaggctttttttgaactcctgagcgcaagtaatccactctccttggcctttcaaagtgttgggattacaggcatgggccaccgtgctggtcctgtttttgccattttaaacccttttatttccttttctgattttatggcattgagcagatctaccggatacaattgtgatagtggaaatttttgtgttattcctgatgagaaatggaaaaatttcaacatttcacgacaatatttagtgtactttttttgtagatggactttttcagagtaagtcaagccattctgttttagtttgttgagagtgttcattttgaatatatgttgaatttcatcaaacactgacctgagtcatcttaaaacatgtgaattgagatttctttgctactaagaaagtgagcgggcactctgcttcatgtttacttttgtcatgttgcatgaaaaacattttgcttcatgtttgattctgtatgttgaaaactgaaatcatctattgtgattaccacagggttttttcccccagtaatctgtttatgtagtcaattacgttgataaatctgtactttttaaattttaacaattgagacaggtctcactctgtcacccatgctgactgcagtagtgtgatcacagcttactgcaacctcaacctcctgggctcaggcgatcctcccacctcaccctcctcagtagctaggactataggtacatgccaccatgccaagctaatttttctgttttagagatggtattttttcatgttgcccaggctggttttatactcctaatctcaagccatccactagcctcagcctcccaaagtgctgggattacaggaatgagtcacggtgcctggaaattttgtacatttaaaccaacaatttggtcatgggtaatctatgtcctaataatttatttaaggatttttatgtatatcctcatgagtgacattacctgtacttttatttcatatgctcatttgttggacgttgttatcaaggttcctctagcttcataaaacgggttggtatgtaaaacctctttttccattcactggaactcaagtctcctcaaggctgtgagtaatgcagggctaggctttcccataatgagcttttctagaatgcttctctcagatttggaccctacttaaacagcagtgaccaaacgggcagctccaggtacctatcccctcaaactttgtgagggtcgcgttctctgaagatgcctcttcaatttgaaagctatctgttcctgtttctctgctgatattaactctctgtgcacagaaagttaaacgtcactggttattaatttccctagattttgatctgtgctgtgtggctgagaatgggctgactgaccctagatctgtgtataattatgacaatggctccatttatttttaaaataagaggaattattataaaattcctatttactggatgtgtactatctatgaattacttctttgtgctaggttgtgtacatgtatgacctctttagatcctcacaagataaggcagaattttcatgaaattgatgactgactccagtaagaagcagatttggggggatttcaatttctaagctcaaagcccttgcacttttctcaaagtaaagcttttgaaagtgttaaatgtacacgaactgatggtgtatatgatgattttagttgtaatctgatgttttctttaaaaatttacatatacaaaagtgtttgactcaaaaggctttgttcttcccttaaaggaagcatctaccaaaatgtggcacacaaaccttgcatggtgtctctagggcctcctaccccgcatttcccctgctttttctcttgttctgactgaaaaacaaagtgctttgactgtgctgtgacccagccagctgcatgtttacccagcatgcttgaacccaagctggagccttgaacataaaggtgtttaagttgttgctcaaaatatggaaagaatctagctctggccttgaaccaaatcccttaaactctcctataaaactccataacctgaccccctcagtgcggatatacctaggcatgacattcttgttgcctgttgcgaggatgctttagcctactctaagttctcccaataaatgctttggactgat

SEQ ID NO: 135673 - DNA, 564 bp, Homo sapiens
  Payload ID: 6523
  Gene Symbol: GAGE1
  Gene Name: G antigen 1
  Uniprot ID: Q13068
  ENST ID: ENST00000610680
  CDS Start-End: 117-470
gtcttctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaagggcaatcacagtgttaaaagaagacatgctgaaatgttgcaggctgctcctatgttggaaaattcttcattgaagttctcccaataaagctttacagccttctgcaaagaa

SEQ ID NO: 135674 - DNA, 2873 bp, Homo sapiens
  Payload ID: 6523
  Gene Symbol: GAGE1
  Gene Name: G antigen 1
  Uniprot ID: Q13068
  ENST ID: ENST00000619375
  CDS Start-End: 1-354
atgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaagggcaatcacagtgttaaaagaagacatgctgaaatgttgcaggctgctcctatgttggaaaattcttcattgaagttctcccaataaagctttacagccttctgcaaagaagtcttgtgaatcttttgtcaattttatttctagctatttgatgctgtgaaatgtttcattctttgcaattttgtattctatctccttgagctgtgtgtagaggcataattctcatgtattgattttctatccagcaaccttgttaaatatgcttatgaattttaaaagtttacttctaggttttttcagttttcaacctacagaatcatatcatttttgaataagaacaattttgtttctgccttttttgtttgttttttcttttgtatttttcgtagaggtgggattttggcctgtgtcctaggctttttttgaactcctgagcgcaagtaatccactctccttggcctttcaaagtgttgggattacaggcatgggccaccgtgctggtcctgtttttgccattttaaacccttttatttccttttctgattttatggcattgagcagatctaccggatacaattgtgatagtggaaatttttgtgttattcctgatgagaaatggaaaaatttcaacatttcacgacaatatttagtgtactttttttgtagatggactttttcagagtaagtcaagccattctgttttagtttgttgagagtgttcattttgaatatatgttgaatttcatcaaacactgacctgagtcatcttaaaacatgtgaattgagatttctttgctactaagaaagtgagcgggcactctgcttcatgtttacttttgtcatgttgcatgaaaaacattttgcttcatgtttgattctgtatgttgaaaactgaaatcatctattgtgattaccacagggttttttcccccagtaatctgtttatgtagtcaattacgttgataaatctgtactttttaaattttaacaattgagacaggtctcactctgtcacccatgctgactgcagtagtgtgatcacagcttactgcaacctcaacctcctgggctcaggcgatcctcccacctcaccctcctcagtagctaggactataggtacatgccaccatgccaagctaatttttctgttttagagatggtattttttcatgttgcccaggctggttttatactcctaatctcaagccatccactagcctcagcctcccaaagtgctgggattacaggaatgagtcacggtgcctggaaattttgtacatttaaaccaacaatttggtcatgggtaatctatgtcctaataatttatttaaggatttttatgtatatcctcatgagtgacattacctgtacttttatttcatatgctcatttgttggacgttgttatcaaggttcctctagcttcataaaacgggttggtatgtaaaacctctttttccattcactggaactcaagtctcctcaaggctgtgagtaatgcagggctaggctttcccataatgagcttttctagaatgcttctctcagatttggaccctacttaaacagcagtgaccaaacgggcagctccaggtacctatcccctcaaactttgtgagggtcgcgttctctgaagatgcctcttcaatttgaaagctatctgttcctgtttctctgctgatattaactctctgtgcacagaaagttaaacgtcactggttattaatttccctagattttgatctgtgctgtgtggctgagaatgggctgactgaccctagatctgtgtataattatgacaatggctccatttatttttaaaataagaggaattattataaaattcctatttactggatgtgtactatctatgaattacttctttgtgctaggttgtgtacatgtatgacctctttagatcctcacaagataaggcagaattttcatgaaattgatgactgactccagtaagaagcagatttggggggatttcaatttctaagctcaaagcccttgcacttttctcaaagtaaagcttttgaaagtgttaaatgtacacgaactgatggtgtatatgatgattttagttgtaatctgatgttttctttaaaaatttacatatacaaaagtgtttgactcaaaaggctttgttcttcccttaaaggaagcatctaccaaaatgtggcacacaaaccttgcatggtgtctctagggcctcctaccccgcatttcccctgctttttctcttgttctgactgaaaaacaaagtgctttgactgtgctgtgacccagccagctgcatgtttacccagcatgcttgaacccaagctggagccttgaacataaaggtgtttaagttgttgctcaaaatatggaaagaatctagctctggccttgaaccaaatcccttaaactctcctataaaactccataacctgaccccctcagtgcggatatacctaggcatgacattcttgttgcctgttgcgaggatgctttagcctactctaagttctcccaataaatgctttggactg

SEQ ID NO: 135675 - DNA, 538 bp, Homo sapiens
  Payload ID: 6524
  Gene Symbol: GAGE10
  Gene Name: G antigen 10
  Uniprot ID: A6NGK3
  ENST ID: ENST00000407599
  CDS Start-End: 94-444
cacgtggagaacgccagggagctgtgagggtgtgtggtctcgttcctgtcgtctggaatatttttcctctactgagattcatctgtgtgaaatatgagttggcgaggaagatcgacctatcggcctagaccaagacgctacgtagagccccctgaaatgattgggcctatgctgcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacaggttcacccaaagactgggtgtgagtgtggagatggtcctgatggccaggagatgggcctgccaaatccagaggaggtgaaaaggcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 135676 - DNA, 117 bp, Homo sapiens
  Payload ID: 6525
  Gene Symbol: GAGE12B
  Gene Name: G antigen 12B
  ENST ID: ENST00000361446
  CDS Start-End: 1-23
gtgaaaagcaatcacagtgttaaaagaagacacgttgaaatgatgcaggctgctcctatgttggaaatttgttcattaaaattctcccaataaagctttacagccttctgcaaagaa

SEQ ID NO: 135677 - DNA, 527 bp, Homo sapiens
  Payload ID: 6526
  Gene Symbol: GAGE12C
  Gene Name: G antigen 12C
  Uniprot ID: A1L429
  ENST ID: ENST00000420398
  CDS Start-End: 83-436
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 135678 - DNA, 527 bp, Homo sapiens; identical to SEQ ID NO: 135677
  Payload ID: 6527
  Gene Symbol: GAGE12D
  Gene Name: G antigen 12D
  Uniprot ID: A1L429
  ENST ID: ENST00000405679
  CDS Start-End: 83-436

SEQ ID NO: 135679 - DNA, 520 bp, Homo sapiens
  Payload ID: 6528
  Gene Symbol: GAGE12E
  Gene Name: G antigen 12E
  Uniprot ID: A1L429
  ENST ID: ENST00000381698
  CDS Start-End: 73-426
ctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 135680 - DNA, 527 bp, Homo sapiens
  Payload ID: 6529
  Gene Symbol: GAGE12F
  Gene Name: G antigen 12F
  Uniprot ID: P0CL80
  ENST ID: ENST00000440137
  CDS Start-End: 83-436
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 135681 - DNA, 527 bp, Homo sapiens; identical to SEQ ID NO: 135680
  Payload ID: 6530
  Gene Symbol: GAGE12G
  Gene Name: G antigen 12G
  Uniprot ID: P0CL81
  ENST ID: ENST00000445148
  CDS Start-End: 83-436

SEQ ID NO: 135682 - DNA, 527 bp, Homo sapiens
  Payload ID: 6531
  Gene Symbol: GAGE12H
  Gene Name: G antigen 12H
  Uniprot ID: A6NDE8
  ENST ID: ENST00000381722
  CDS Start-End: 83-436
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcagaagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 135683 - DNA, 541 bp, Homo sapiens
  Payload ID: 6532
  Gene Symbol: GAGE12J
  Gene Name: G antigen 12J
  Uniprot ID: A6NER3
  ENST ID: ENST00000442437
  CDS Start-End: 97-450
gcccacgtgaagaacgccagggagctgtgaggcagtgctgtgtggttcctgccgtccggactctttttcctctactgagattcatctgtgtgaaatatgagttggcgaggaagatcgacctattattggcctagaccaagaccctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 135684 - DNA, 530 bp, Homo sapiens
  Payload ID: 6533
  Gene Symbol: GAGE13
  Gene Name: G antigen 13
  ENST ID: ENST00000612958
  CDS Start-End: 83-436
cgccagggagctgtgaggcagtgctgtgtggttcctgccgtccggactctttttcctctactgagattcatctgtgtgaaatatgagttggcgaggaagatcgacctattattggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 135685 - DNA, 528 bp, Homo sapiens
  Payload ID: 6534
  Gene Symbol: GAGE2A
  Gene Name: G antigen 2A
  Uniprot ID: Q6NT46
  ENST ID: ENST00000362097
  CDS Start-End: 84-434
acgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 135686 - DNA, 403 bp, Homo sapiens
  Payload ID: 6535
  Gene Symbol: GAGE2E
  Gene Name: G antigen 2E
  ENST ID: ENST00000621907
  CDS Start-End: 73-403
ctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaag

SEQ ID NO: 135687 - DNA, 3453 bp, Homo sapiens
  Payload ID: 6536
  Gene Symbol: GFM1
  Gene Name: G elongation factor, mitochondrial 1
  Uniprot ID: Q96RP9
  ENST ID: ENST00000264263
  CDS Start-End: 39-2351
cggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttgggcacttcctgagggatttccttcctctgctatggaattgggatcgcaggtctggcagtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 135688 - DNA, 3470 bp, Homo sapiens
  Payload ID: 6536
  Gene Symbol: GFM1
  Gene Name: G elongation factor, mitochondrial 1
  ENST ID: ENST00000478254
  CDS Start-End: 108-1469
ctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaaggcaacaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggcaagtacagagaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgattttaaa

SEQ ID NO: 135689 - DNA, 502 bp, Homo sapiens
  Payload ID: 6536
  Gene Symbol: GFM1
  Gene Name: G elongation factor, mitochondrial 1
  ENST ID: ENST00000464732
  CDS Start-End: 322-502
agaggaagcaggtaccggagcatagagaggctaaatcgggaccattcccggaaccttgtgatcccttctgggcaatggaaggccgtgacaccccctgggtcctcatgactgacagctccgaatactggcagtcgctcgtcagtgctgaaaagcacctcggtgcctgcacattagctcgttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctga

SEQ ID NO: 135690 - DNA, 2147 bp, Homo sapiens
  Payload ID: 6536
  Gene Symbol: GFM1
  Gene Name: G elongation factor, mitochondrial 1
  ENST ID: ENST00000478576
  CDS Start-End: 108-1883
ctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggtaaatttttaaaaaagtgtttttgcatttttacttactaaaaacagtttatcaggtattaaatcatactttgtcttccatcatgttgtctatcacagtttgttttagttacagtcctgtttctctgattgttaagctttccatctgatttagaatctctaattcattaagcagaagagctgtaaatccatgctgtgacaatgatgggaaattattatgtttctgaatcatagttatatttttcttaataaattgaaactactgtattgattgtaa

SEQ ID NO: 135691 - DNA, 3721 bp, Homo sapiens
  Payload ID: 6536
  Gene Symbol: GFM1
  Gene Name: G elongation factor, mitochondrial 1
  Uniprot ID: Q96RP9
  ENST ID: ENST00000486715
  CDS Start-End: 358-2613
ttctgtatcttcatacagaggtaatatttaaaaaagaagacgaagacaaaaggactcccttccctcacccatatacctatgccgtcttactgggagcaaacacttctttagctccgcaaagcgattgcactttctcttccaagtcggcagacggcgcgcgagcagcgtaggcactgctccgcctccaatccagttgctcttctttcttttcctcactctctttttcctcgcgtcctttgccccggaagtgctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgattttaaattc

SEQ ID NO: 135692 - DNA, 656 bp, Homo sapiens
  Payload ID: 6536
  Gene Symbol: GFM1
  Gene Name: G elongation factor, mitochondrial 1
  ENST ID: ENST00000472383
  CDS Start-End: 1-52
ctctttcatccgagcaggagaaggtgctcttaaacaaggtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacggg

SEQ ID NO: 135693 - DNA, 2856 bp, Homo sapiens
  Payload ID: 6537
  Gene Symbol: GFM2
  Gene Name: G elongation factor, mitochondrial 2
  Uniprot ID: Q969S9
  ENST ID: ENST00000345239
  CDS Start-End: 209-2407
tggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagtaca

SEQ ID NO: 135694 - DNA, 3249 bp, Homo sapiens
  Payload ID: 6537
  Gene Symbol: GFM2
  Gene Name: G elongation factor, mitochondrial 2
  Uniprot ID: Q969S9
  ENST ID: ENST00000296805
  CDS Start-End: 459-2798
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagtacaga

SEQ ID NO: 135695 - DNA, 1870 bp, Homo sapiens
  Payload ID: 6537
  Gene Symbol: GFM2
  Gene Name: G elongation factor, mitochondrial 2
  Uniprot ID: Q969S9
  ENST ID: ENST00000427854
  CDS Start-End: 234-1775
tttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccaggtataaatggtcttagtgtgtcaactaattagtgcgctgataatttatataaaatagttgcaatataccctcaagagatttcttatgtgattgaggtaaattttatctgaatatattggtaaacatt

SEQ ID NO: 135696 - DNA, 1004 bp, Homo sapiens
  Payload ID: 6537
  Gene Symbol: GFM2
  Gene Name: G elongation factor, mitochondrial 2
  ENST ID: ENST00000509097
  CDS Start-End: 149-1004
acattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgc

SEQ ID NO: 135697 - DNA, 566 bp, Homo sapiens
  Payload ID: 6537
  Gene Symbol: GFM2
  Gene Name: G elongation factor, mitochondrial 2
  ENST ID: ENST00000506778
  CDS Start-End: 373-566
atttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagaatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaat

SEQ ID NO: 135698 - DNA, 3047 bp, Homo sapiens
  Payload ID: 6537
  Gene Symbol: GFM2
  Gene Name: G elongation factor, mitochondrial 2
  Uniprot ID: Q969S9
  ENST ID: ENST00000509430
  CDS Start-End: 311-2650
cgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagtcacaactgtggagagactatgaggccctgaactttggcgttaccaatgaaaagggaatggattcaaggccaggcatggtggctcacgcctgtaatcccagcactttgggaggccgagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaa

SEQ ID NO: 135699 - DNA, 1511 bp, Homo sapiens
  Payload ID: 6538
  Gene Symbol: GKAP1
  Gene Name: G kinase anchoring protein 1
  Uniprot ID: Q5VSY0
  ENST ID: ENST00000376365
  CDS Start-End: 292-1239
cgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttcttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttcca

SEQ ID NO: 135700 - DNA, 1778 bp, Homo sapiens
  Payload ID: 6538
  Gene Symbol: GKAP1
  Gene Name: G kinase anchoring protein 1
  Uniprot ID: Q5VSY0
  ENST ID: ENST00000376371
  CDS Start-End: 402-1502
tgcagccgcgctcacctccgcggtccgccccggcgccccgggacccgttagtgcccagcctgtgggccgaccgcgacccccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttcttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccactaa

SEQ ID NO: 135701 - DNA, 1231 bp, Homo sapiens
  Payload ID: 6538
  Gene Symbol: GKAP1
  Gene Name: G kinase anchoring protein 1
  ENST ID: ENST00000388782
  CDS Start-End: 526-906
agaaaagaagaatactaacatacagttttcctgagttaccttaagtgagttgaaaactaaaagccctatccctcaaggaacttacagtccagtgacattacttatggagagagtaaagcaggcctgcagccgcgctcacctccgcggtccgccccggcgccccgggacccgttagtgcccagcctgtgggccgaccgcgacccccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagatggggagtaggaggcaatgaggaagtcaagaggaaggggatctgaagtactccatcttggacacatctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactg

SEQ ID NO: 135702 - DNA, 403 bp, Homo sapiens
  Payload ID: 6538
  Gene Symbol: GKAP1
  Gene Name: G kinase anchoring protein 1
  ENST ID: ENST00000485742
  CDS Start-End: 241-403
acccgactcccaggccggcgaccgctgagcctcccgagaccccgtgggggccgctcgagtgacaggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaa

SEQ ID NO: 135703 - DNA, 2793 bp, Homo sapiens
  Payload ID: 6539
  Gene Symbol: GPANK1
  Gene Name: G patch domain and ankyrin repeats 1
  Uniprot ID: O95872
  ENST ID: ENST00000211377
  CDS Start-End: 686-1756
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 135704 - DNA, 1598 bp, Homo sapiens
  Payload ID: 6539
  Gene Symbol: GPANK1
  Gene Name: G patch domain and ankyrin repeats 1
  Uniprot ID: O95872
  ENST ID: ENST00000375893
  CDS Start-End: 338-1408
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135705 - DNA, 1800 bp, Homo sapiens
  Payload ID: 6539
  Gene Symbol: GPANK1
  Gene Name: G patch domain and ankyrin repeats 1
  Uniprot ID: O95872
  ENST ID: ENST00000375895
  CDS Start-End: 540-1610
cggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135706 - DNA, 1910 bp, Homo sapiens
  Payload ID: 6539
  Gene Symbol: GPANK1
  Gene Name: G patch domain and ankyrin repeats 1
  Uniprot ID: O95872
  ENST ID: ENST00000375896
  CDS Start-End: 650-1720
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135707 - DNA, 1814 bp, Homo sapiens
  Payload ID: 6539
  Gene Symbol: GPANK1
  Gene Name: G patch domain and ankyrin repeats 1
  Uniprot ID: O95872
  ENST ID: ENST00000375900
  CDS Start-End: 554-1624
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135708 - DNA, 2793 bp, Homo sapiens
  Payload ID: 6539
  Gene Symbol: GPANK1
  Gene Name: G patch domain and ankyrin repeats 1
  Uniprot ID: O95872
  ENST ID: ENST00000375906
  CDS Start-End: 686-1756
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 135709 - DNA, 1598 bp, Homo sapiens
  Payload ID: 6539
  Gene Symbol: GPANK1
  Gene Name: G patch domain and ankyrin repeats 1
  Uniprot ID: O95872
  ENST ID: ENST00000383434
  CDS Start-End: 338-1408
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 135710 - DNA, 1814 bp, Homo sapiens
  Payload ID: 6539
  Gene Symbol: GPANK1
  Gene Name: G patch domain and ankyrin repeats 1
  Uniprot ID: O95872
  ENST ID: ENST00000383436
  CDS Start-End: 554-1624
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 135711 - DNA, 1910 bp, Homo sapiens
  Payload ID: 6539
  Gene Symbol: GPANK1
  Gene Name: G patch domain and ankyrin repeats 1
  Uniprot ID: O95872
  ENST ID: ENST00000400129
  CDS Start-End: 650-1720
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 135712 - DNA, 1800 bp, Homo sapiens
  Payload ID: 6539
  Gene Symbol: GPANK1
  Gene Name: G patch domain and ankyrin repeats 1
  Uniprot ID: O95872
  ENST ID: ENST00000400134
  CDS Start-End: 540-1610
cggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 135713 - DNA, 2798 bp, Homo sapiens
  Payload ID: 6539
  Gene Symbol: GPANK1
  Gene Name: G patch domain and ankyrin repeats 1
  Uniprot ID: O95872
  ENST ID: ENST00000400139
  CDS Start-End: 686-1756
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgattcacaaacataagtccatatactatgtgccaagaatacaggtaaagacattcccaaccctcaaagagttcacagctggagagggaaagtgccatgttatcaatttttttctttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggagggcccacgattatcaagcttgtacacttagttgaactgggaccagaactctagcccccaaatctaaactttaagtcaaacttctttgttccaccc

SEQ ID NO: 135714 - DNA, 986 bp, Homo sapiens
  Payload ID: 6539
  Gene Symbol: GPANK1
  Gene Name: G patch domain and ankyrin repeats 1
  ENST ID: ENST00000423574
  CDS Start-End: 391-986
gacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagag

SEQ ID NO: 135715 - DNA, 2794 bp, Homo sapiens
  Payload ID: 6539
  Gene Symbol: GPANK1
  Gene Name: G patch domain and ankyrin repeats 1
  ENST ID: ENST00000419261
  CDS Start-End: 687-1757
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 135716 - DNA, 1910 bp, Homo sapiens
  Payload ID: 6539
  Gene Symbol: GPANK1
  Gene Name: G patch domain and ankyrin repeats 1
  ENST ID: ENST00000430994
  CDS Start-End: 650-1720
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135717 - DNA, 1814 bp, Homo sapiens; identical to SEQ ID NO: 135710
  Payload ID: 6539
  Gene Symbol: GPANK1
  Gene Name: G patch domain and ankyrin repeats 1
  Uniprot ID: O95872
  ENST ID: ENST00000414528
  CDS Start-End: 554-1624

SEQ ID NO: 135718 - DNA, 1598 bp, Homo sapiens
  Payload ID: 6539
  Gene Symbol: GPANK1
  Gene Name: G patch domain and ankyrin repeats 1
  ENST ID: ENST00000419139
  CDS Start-End: 338-1408
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135719 - DNA, 1598 bp, Homo sapiens; identical to SEQ ID NO: 135704
  Payload ID: 6539
  Gene Symbol: GPANK1
  Gene Name: G patch domain and ankyrin repeats 1
  Uniprot ID: O95872
  ENST ID: ENST00000453746
  CDS Start-End: 338-1408

SEQ ID NO: 135720 - DNA, 822 bp, Homo sapiens
  Payload ID: 6539
  Gene Symbol: GPANK1
  Gene Name: G patch domain and ankyrin repeats 1
  ENST ID: ENST00000432713
  CDS Start-End: 367-822
cgccacctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcga

SEQ ID NO: 135721 - DNA, 1598 bp, Homo sapiens
  Payload ID: 6539
  Gene Symbol: GPANK1
  Gene Name: G patch domain and ankyrin repeats 1
  Uniprot ID: O95872
  ENST ID: ENST00000427527
  CDS Start-End: 338-1408
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135722 - DNA, 627 bp, Homo sapiens
  Payload ID: 6539
  Gene Symbol: GPANK1
  Gene Name: G patch domain and ankyrin repeats 1
  ENST ID: ENST00000443202
  CDS Start-End: 359-627
cctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcagg

SEQ ID NO: 135723 - DNA, 751 bp, Homo sapiens
  Payload ID: 6539
  Gene Symbol: GPANK1
  Gene Name: G patch domain and ankyrin repeats 1
  ENST ID: ENST00000418144
  CDS Start-End: 431-751
gggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccgg

SEQ ID NO: 135724 - DNA, 751 bp, Homo sapiens
  Payload ID: 6539
  Gene Symbol: GPANK1
  Gene Name: G patch domain and ankyrin repeats 1
  ENST ID: ENST00000441661
  CDS Start-End: 431-751
gggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccgg

SEQ ID NO: 135725 - DNA, 822 bp, Homo sapiens; identical to SEQ ID NO: 135720
  Payload ID: 6539
  Gene Symbol: GPANK1
  Gene Name: G patch domain and ankyrin repeats 1
  ENST ID: ENST00000415256
  CDS Start-End: 367-822

SEQ ID NO: 135726 - DNA, 751 bp, Homo sapiens
  Payload ID: 6539
  Gene Symbol: GPANK1
  Gene Name: G patch domain and ankyrin repeats 1
  ENST ID: ENST00000453239
  CDS Start-End: 431-751
gggcaatacagttttgtgctcactgggtgaagaggctgacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccgg

SEQ ID NO: 135727 - DNA, 1910 bp, Homo sapiens; identical to SEQ ID NO: 135706
  Payload ID: 6539
  Gene Symbol: GPANK1
  Gene Name: G patch domain and ankyrin repeats 1
  Uniprot ID: O95872
  ENST ID: ENST00000449868
  CDS Start-End: 650-1720

SEQ ID NO: 135728 - DNA, 802 bp, Homo sapiens
  Payload ID: 6539
  Gene Symbol: GPANK1
  Gene Name: G patch domain and ankyrin repeats 1
  ENST ID: ENST00000458083
  CDS Start-End: 309-802
cttaggctctaagtgtgaccttcgaaccctggtcagagtaatgaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccg

SEQ ID NO: 135729 - DNA, 627 bp, Homo sapiens; identical to SEQ ID NO: 135722
  Payload ID: 6539
  Gene Symbol: GPANK1
  Gene Name: G patch domain and ankyrin repeats 1
  ENST ID: ENST00000456540
  CDS Start-End: 359-627

SEQ ID NO: 135730 - DNA, 627 bp, Homo sapiens
  Payload ID: 6539
  Gene Symbol: GPANK1
  Gene Name: G patch domain and ankyrin repeats 1
  ENST ID: ENST00000416364
  CDS Start-End: 359-627
cctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcagg

SEQ ID NO: 135731 - DNA, 1910 bp, Homo sapiens; identical to SEQ ID NO: 135711
  Payload ID: 6539
  Gene Symbol: GPANK1
  Gene Name: G patch domain and ankyrin repeats 1
  Uniprot ID: O95872
  ENST ID: ENST00000426326
  CDS Start-End: 650-1720

SEQ ID NO: 135732 - DNA, 1800 bp, Homo sapiens; identical to SEQ ID NO: 135705
  Payload ID: 6539
  Gene Symbol: GPANK1
  Gene Name: G patch domain and ankyrin repeats 1
  Uniprot ID: O95872
  ENST ID: ENST00000440777
  CDS Start-End: 540-1610

SEQ ID NO: 135733 - DNA, 751 bp, Homo sapiens; identical to SEQ ID NO: 135723
  Payload ID: 6539
  Gene Symbol: GPANK1
  Gene Name: G patch domain and ankyrin repeats 1
  ENST ID: ENST00000430230
  CDS Start-End: 431-751

SEQ ID NO: 135734 - DNA, 627 bp, Homo sapiens; identical to SEQ ID NO: 135730
  Payload ID: 6539
  Gene Symbol: GPANK1
  Gene Name: G patch domain and ankyrin repeats 1
  ENST ID: ENST00000438225
  CDS Start-End: 359-627

SEQ ID NO: 135735 - DNA, 986 bp, Homo sapiens
  Payload ID: 6539
  Gene Symbol: GPANK1
  Gene Name: G patch domain and ankyrin repeats 1
  ENST ID: ENST00000426953
  CDS Start-End: 391-986
gacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagag

SEQ ID NO: 135736 - DNA, 2798 bp, Homo sapiens; identical to SEQ ID NO: 135713
  Payload ID: 6539
  Gene Symbol: GPANK1
  Gene Name: G patch domain and ankyrin repeats 1
  Uniprot ID: O95872
  ENST ID: ENST00000433880
  CDS Start-End: 686-1756

SEQ ID NO: 135737 - DNA, 1800 bp, Homo sapiens
  Payload ID: 6539
  Gene Symbol: GPANK1
  Gene Name: G patch domain and ankyrin repeats 1
  Uniprot ID: O95872
  ENST ID: ENST00000456191
  CDS Start-End: 540-1610
cggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135738 - DNA, 802 bp, Homo sapiens; identical to SEQ ID NO: 135728
  Payload ID: 6539
  Gene Symbol: GPANK1
  Gene Name: G patch domain and ankyrin repeats 1
  ENST ID: ENST00000412886
  CDS Start-End: 309-802

SEQ ID NO: 135739 - DNA, 2793 bp, Homo sapiens; identical to SEQ ID NO: 135708
  Payload ID: 6539
  Gene Symbol: GPANK1
  Gene Name: G patch domain and ankyrin repeats 1
  Uniprot ID: O95872
  ENST ID: ENST00000416384
  CDS Start-End: 686-1756

SEQ ID NO: 135740 - DNA, 802 bp, Homo sapiens; identical to SEQ ID NO: 135728
  Payload ID: 6539
  Gene Symbol: GPANK1
  Gene Name: G patch domain and ankyrin repeats 1
  ENST ID: ENST00000420352
  CDS Start-End: 309-802

SEQ ID NO: 135741 - DNA, 751 bp, Homo sapiens; identical to SEQ ID NO: 135724
  Payload ID: 6539
  Gene Symbol: GPANK1
  Gene Name: G patch domain and ankyrin repeats 1
  ENST ID: ENST00000440952
  CDS Start-End: 431-751

SEQ ID NO: 135742 - DNA, 1910 bp, Homo sapiens
  Payload ID: 6539
  Gene Symbol: GPANK1
  Gene Name: G patch domain and ankyrin repeats 1
  Uniprot ID: O95872
  ENST ID: ENST00000447705
  CDS Start-End: 650-1720
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135743 - DNA, 822 bp, Homo sapiens
  Payload ID: 6539
  Gene Symbol: GPANK1
  Gene Name: G patch domain and ankyrin repeats 1
  ENST ID: ENST00000424420
  CDS Start-End: 367-822
cgccacctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcga

SEQ ID NO: 135744 - DNA, 627 bp, Homo sapiens; identical to SEQ ID NO: 135722
  Payload ID: 6539
  Gene Symbol: GPANK1
  Gene Name: G patch domain and ankyrin repeats 1
  ENST ID: ENST00000442498
  CDS Start-End: 359-627

SEQ ID NO: 135745 - DNA, 802 bp, Homo sapiens
  Payload ID: 6539
  Gene Symbol: GPANK1
  Gene Name: G patch domain and ankyrin repeats 1
  ENST ID: ENST00000450924
  CDS Start-End: 309-802
cttaggctctaagtgtgaccttcgaaccctggtcagagtaatgaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccg

SEQ ID NO: 135746 - DNA, 1800 bp, Homo sapiens; identical to SEQ ID NO: 135712
  Payload ID: 6539
  Gene Symbol: GPANK1
  Gene Name: G patch domain and ankyrin repeats 1
  Uniprot ID: O95872
  ENST ID: ENST00000457505
  CDS Start-End: 540-1610

SEQ ID NO: 135747 - DNA, 751 bp, Homo sapiens; identical to SEQ ID NO: 135724
  Payload ID: 6539
  Gene Symbol: GPANK1
  Gene Name: G patch domain and ankyrin repeats 1
  ENST ID: ENST00000418462
  CDS Start-End: 431-751

SEQ ID NO: 135748 - DNA, 1814 bp, Homo sapiens
  Payload ID: 6539
  Gene Symbol: GPANK1
  Gene Name: G patch domain and ankyrin repeats 1
  Uniprot ID: O95872
  ENST ID: ENST00000433857
  CDS Start-End: 554-1624
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135749 - DNA, 627 bp, Homo sapiens; identical to SEQ ID NO: 135730
  Payload ID: 6539
  Gene Symbol: GPANK1
  Gene Name: G patch domain and ankyrin repeats 1
  ENST ID: ENST00000440374
  CDS Start-End: 359-627

SEQ ID NO: 135750 - DNA, 802 bp, Homo sapiens; identical to SEQ ID NO: 135728
  Payload ID: 6539
  Gene Symbol: GPANK1
  Gene Name: G patch domain and ankyrin repeats 1
  ENST ID: ENST00000438145
  CDS Start-End: 309-802

SEQ ID NO: 135751 - DNA, 1800 bp, Homo sapiens; identical to SEQ ID NO: 135705
  Payload ID: 6539
  Gene Symbol: GPANK1
  Gene Name: G patch domain and ankyrin repeats 1
  Uniprot ID: O95872
  ENST ID: ENST00000439710
  CDS Start-End: 540-1610

SEQ ID NO: 135752 - DNA, 802 bp, Homo sapiens; identical to SEQ ID NO: 135745
  Payload ID: 6539
  Gene Symbol: GPANK1
  Gene Name: G patch domain and ankyrin repeats 1
  ENST ID: ENST00000424195
  CDS Start-End: 309-802

SEQ ID NO: 135753 - DNA, 822 bp, Homo sapiens; identical to SEQ ID NO: 135720
  Payload ID: 6539
  Gene Symbol: GPANK1
  Gene Name: G patch domain and ankyrin repeats 1
  ENST ID: ENST00000445768
  CDS Start-End: 367-822

SEQ ID NO: 135754 - DNA, 1800 bp, Homo sapiens
  Payload ID: 6539
  Gene Symbol: GPANK1
  Gene Name: G patch domain and ankyrin repeats 1
  ENST ID: ENST00000423886
  CDS Start-End: 540-1610
cggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135755 - DNA, 1814 bp, Homo sapiens; identical to SEQ ID NO: 135707
  Payload ID: 6539
  Gene Symbol: GPANK1
  Gene Name: G patch domain and ankyrin repeats 1
  Uniprot ID: O95872
  ENST ID: ENST00000422131
  CDS Start-End: 554-1624

SEQ ID NO: 135756 - DNA, 2793 bp, Homo sapiens
  Payload ID: 6539
  Gene Symbol: GPANK1
  Gene Name: G patch domain and ankyrin repeats 1
  Uniprot ID: O95872
  ENST ID: ENST00000448091
  CDS Start-End: 686-1756
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttaccaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 135757 - DNA, 1910 bp, Homo sapiens; identical to SEQ ID NO: 135706
  Payload ID: 6539
  Gene Symbol: GPANK1
  Gene Name: G patch domain and ankyrin repeats 1
  Uniprot ID: O95872
  ENST ID: ENST00000418502
  CDS Start-End: 650-1720

SEQ ID NO: 135758 - DNA, 986 bp, Homo sapiens
  Payload ID: 6539
  Gene Symbol: GPANK1
  Gene Name: G patch domain and ankyrin repeats 1
  ENST ID: ENST00000446315
  CDS Start-End: 391-986
gacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagag

SEQ ID NO: 135759 - DNA, 1598 bp, Homo sapiens; identical to SEQ ID NO: 135704
  Payload ID: 6539
  Gene Symbol: GPANK1
  Gene Name: G patch domain and ankyrin repeats 1
  Uniprot ID: O95872
  ENST ID: ENST00000429266
  CDS Start-End: 338-1408

SEQ ID NO: 135760 - DNA, 986 bp, Homo sapiens; identical to SEQ ID NO: 135714
  Payload ID: 6539
  Gene Symbol: GPANK1
  Gene Name: G patch domain and ankyrin repeats 1
  ENST ID: ENST00000429097
  CDS Start-End: 391-986

SEQ ID NO: 135761 - DNA, 822 bp, Homo sapiens; identical to SEQ ID NO: 135720
  Payload ID: 6539
  Gene Symbol: GPANK1
  Gene Name: G patch domain and ankyrin repeats 1
  ENST ID: ENST00000458699
  CDS Start-End: 367-822

SEQ ID NO: 135762 - DNA, 1598 bp, Homo sapiens; identical to SEQ ID NO: 135709
  Payload ID: 6539
  Gene Symbol: GPANK1
  Gene Name: G patch domain and ankyrin repeats 1
  Uniprot ID: O95872
  ENST ID: ENST00000453899
  CDS Start-End: 338-1408

SEQ ID NO: 135763 - DNA, 986 bp, Homo sapiens; identical to SEQ ID NO: 135735
  Payload ID: 6539
  Gene Symbol: GPANK1
  Gene Name: G patch domain and ankyrin repeats 1
  ENST ID: ENST00000424956
  CDS Start-End: 391-986

SEQ ID NO: 135764 - DNA, 627 bp, Homo sapiens; identical to SEQ ID NO: 135722
  Payload ID: 6539
  Gene Symbol: GPANK1
  Gene Name: G patch domain and ankyrin repeats 1
  ENST ID: ENST00000452805
  CDS Start-End: 359-627

SEQ ID NO: 135765 - DNA, 822 bp, Homo sapiens; identical to SEQ ID NO: 135743
  Payload ID: 6539
  Gene Symbol: GPANK1
  Gene Name: G patch domain and ankyrin repeats 1
  ENST ID: ENST00000424399
  CDS Start-End: 367-822

SEQ ID NO: 135766 - DNA, 1814 bp, Homo sapiens
  Payload ID: 6539
  Gene Symbol: GPANK1
  Gene Name: G patch domain and ankyrin repeats 1
  ENST ID: ENST00000426206
  CDS Start-End: 554-1624
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 135767 - DNA, 1814 bp, Homo sapiens; identical to SEQ ID NO: 135707
  Payload ID: 6539
  Gene Symbol: GPANK1
  Gene Name: G patch domain and ankyrin repeats 1
  Uniprot ID: O95872
  ENST ID: ENST00000417890
  CDS Start-End: 554-1624

SEQ ID NO: 135768 - DNA, 802 bp, Homo sapiens; identical to SEQ ID NO: 135745
  Payload ID: 6539
  Gene Symbol: GPANK1
  Gene Name: G patch domain and ankyrin repeats 1
  ENST ID: ENST00000415610
  CDS Start-End: 309-802

SEQ ID NO: 135769 - DNA, 822 bp, Homo sapiens; identical to SEQ ID NO: 135743
  Payload ID: 6539
  Gene Symbol: GPANK1
  Gene Name: G patch domain and ankyrin repeats 1
  ENST ID: ENST00000414010
  CDS Start-End: 367-822

SEQ ID NO: 135770 - DNA, 986 bp, Homo sapiens; identical to SEQ ID NO: 135735
  Payload ID: 6539
  Gene Symbol: GPANK1
  Gene Name: G patch domain and ankyrin repeats 1
  ENST ID: ENST00000425437
  CDS Start-End: 391-986

SEQ ID NO: 135771 - DNA, 1742 bp, Homo sapiens
  Payload ID: 6540
  Gene Symbol: GPKOW
  Gene Name: G patch domain and KOW motifs
  Uniprot ID: Q92917
  ENST ID: ENST00000156109
  CDS Start-End: 80-1510
actttggccggcccctagcgatctgaacccaaactaaatttcccagcaagcagcgcgccggcctgggaaaaggagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtacttaatagaaagatgaaa

SEQ ID NO: 135772 - DNA, 3492 bp, Homo sapiens
  Payload ID: 6541
  Gene Symbol: GPATCH1
  Gene Name: G patch domain containing 1
  Uniprot ID: Q9BRR8
  ENST ID: ENST00000170564
  CDS Start-End: 315-3110
caggcatcggtgtcgcctcgcagggaacagttgggtggcttccagcttatgccaggagtctcctcctcacccgcacatcgcggggctaggatgggatgtcgtggctgccaaatcctccgaggcaactcctgcctgggacggcctaccacaggatgggcctgagaatccggagcgcaggctcgggccgctaggacaccttcccccgcccgcggacccagccttccagcatcaccggggttcgcggaggagaaagaggaaaggcgtttggcctgccaaggccgccgtagcgagggggcggggcccggaagagcaggatggcggcgcgggacagtgacagcgaagaagatctggtcagctatgggaccgggctggagcctctggaagaaggtgaaagaccaaagaaaccaatccctcttcaggatcagactgtcagagatgaaaaaggaaggtataaacgattccacggggcctttagtggaggtttctctgctggatacttcaatactgttggctcaaaagaaggatggacaccctctacctttgtgtcttcacgacagaacagagcagacaaatctgttcttggtcctgaagattttatggatgaagaggatcttagtgaatttgggatagcacctaaagcgattgtcaccacagacgattttgcctccaaaaccaaagacagaatacgagaaaaggctaggcagttggccgctgctactgcccctattcctggagccaccctccttgatgacctcataacgccagcaaaattatctgttggtttcgaattgctaagaaaaatgggttggaaagaaggacaaggagttggtcctcgagtaaagagacggccacgccgacagaaacctgatcctggagtcaaaatctatggctgtgcattaccccctggaagctcggaaggatctgagggtgaagatgatgactacttgcctgataatgtgacctttgcacccaaagatgtcacacctgtggatttcacacctaaagataatgtgcatggtctagcttacaagggcctggatccccaccaggcactgtttggaacttcgggagaacattttaatcttttcagtggtggttctgagagagctggcgatcttggagaaattggactgaataaaggaagaaaattgggaatttcaggccaggcttttggtgtaggtgccctggaagaggaagatgatgatatctatgccacagaaactctatccaagtatgacactgttctgaaggacgaggagcctggagacggactctatggctggacagcacccaggcagtataaaaaccagaaagaatcagagaaagaccttcggtacgttggcaaaattttggatggattttccttggcttctaaacctttatcttctaagaaaatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggttcagctacttcagtgttagaatttctgtcccaaaaagacaaagagagaatcaaagaaatgaagcaggcaactgacctgaaagcagctcagctcaaggccaggagtctggcccagaacgctcagagcagcagagcccagctctcccctgcagcggctgctgggcactgctcttggaacatggcattaggtggtgggacggccaccttaaaagccagcaacttcaagcctttcgccaaagatccggaaaagcaaaagcgatacgacgagttcttagtacacatgaaacagggtcagaaagatgctctggaacgctgtctggaccccagcatgacagagtgggagcgaggccgtgagcgggatgagtttgcccgggcggccctgctgtacgcatcttcccattcgaccttgtcctccaggttcactcacgccaaggaggaggatgactcagatcaggttgaagtccctcgagaccaagagaatgatgtcggggataagcagtcggctgtgaagatgaagatgtttgggaagctcacccgagacacgtttgagtggcaccctgacaagcttctatgtaagagatttaatgtccctgacccttatccagattcaactttagttggcttaccaagagtgaagcgtgacaagtactcagtcttcaactttctgacgctcccagagacagcttccttgcccaccactcaagcatcaagtgaaaaagtatcacagcaccgaggtcccgacaaatcaagaaaaccatccagatgggatacctctaaacacgaaaagaaagaagattccattagtgaatttttaagtttggctagatcaaaagccgagccacctaaacaacagtccagccccttagtaaacaaagaggaagagcatgcaccagaattatccgcaaatcagaccgtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggcaggctctggggaggccaacttccaaagctcccaagacactgacttgggggaaacatcatctgtggctcacgctcttgtgccagcaccccaggagccgccaccttccttcccgatacaaaagatgcagatagatgaaagagaagagttcggcccgcggctgcctcccgtcttctgccccaatgctcgtcagacacttgaggttcctcaaaaagagaaacataaaaagaacaaagacaagcacaaggccaagaaagagcacaggcggaagaaagagaagaaaaagaaacacaggaagcacaaacacaaaggcaagcaaaagaataaaaaaccagagaaaagtagtagctccgagagttccgacagcagcgacagccagagtgacgaggaaaccgcagacgtgtcgccccaggagctgctgagacggctgaaaagtcttccactaagaaggcagtaattgaatgctgccctggctcgtcctagaatcatttctcctccatgatggaagcccagtgattgttcagttaacgcattgtacagagtgtatttatatgtaaattcctgctgtaaaataatttttaaaaccttgacatttcaaagactgccttgaaaggtcgcagaaattgatttctatttttaatttcagttagtatcgggggaaaaaaatccagactgaacagtttaattaaagtggaatttttctattttcttcttgatttttaaaaaatttcctgggacgttaaaaaagaagttaaaagtgaaggcttctctctggttttgtgatgaagacagcctggactcactgaaggacaagcgtgtgagaaggggcggttgcggcc

SEQ ID NO: 135773 - DNA, 1584 bp, Homo sapiens
  Payload ID: 6541
  Gene Symbol: GPATCH1
  Gene Name: G patch domain containing 1
  ENST ID: ENST00000592165
  CDS Start-End: 296-682
gcagggaacagttgggtggcttccagcttatgccaggagtctcctcctcacccgcacatcgcggggctaggatgggatgtcgtggctgccaaatcctccgaggcaactcctgcctgggacggcctaccacaggatgggcctgagaatccggagcgcaggctcgggccgctaggacaccttcccccgcccgcggacccagccttccagcatcaccggggttcgcggaggagaaagaggaaaggcgtttggcctgccaaggccgccgtagcgagggggcggggcccggaagagcaggatggcggcgcgggacagtgacagcgaagaagatctggtcagctatgggaccgggctggagcctctggaagaaggtgaaagaccaaagaaaccaatccctcttcaggatcagactgtcagagatgaaaaaggaaggtataaacgattccacggggcctttagtggaggtttctctgctggatacttcaatactgttggctcaaaagaaggatggacaccctctacctttgtgtcttcacgacagaacagagcagacaaatctgttcttggtcctgaagattttatggatgaagagatcctggagtcaaaatctatggctgtgcattaccccctggaagctcggaaggatctgagggtgaagatgatgactacttgcctgataatgtgacctttgcacccaaagatgtcacacctgtggatttcacacctaaagataatgtgcatggtctagcttacaagggcctggatccccaccaggcactgtttggaacttcgggagaacattttaatcttttcagtggtggttctgagagagctggcgatcttggagaaattggactgaataaaggaagaaaattgggaatttcaggccaggcttttggtgtaggtgccctggaagaggaagatgatgatatctatgccacagaaactctatccaagtatgacactgttctgaaggacgaggagcctggagacggactctatggctggacagcacccaggcagtataaaaaccagaaagaattcttcagaatgaactcataaacatgaaatttctgggttttgagataatacaagttccaagaatgtgaaattgaatcccacattacctgaagaaattttaaatcagagaaagaccttcggtacgttggcaaaattttggatggattttccttggcttctaaacctttatcttctaagaaaatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggttcagctacttcagtgttagaatttctgtcccaaaaagacaaagagagaatcaaagaaatgaagcaggcaactgacctgaaagcagctcagctcaaggccaggagtctggcccagaacgctcagagcagcagagcccagctctcccctgcagcggctgct

SEQ ID NO: 135774 - DNA, 3570 bp, Homo sapiens
  Payload ID: 6542
  Gene Symbol: GPATCH11
  Gene Name: G patch domain containing 11
  Uniprot ID: Q8N954
  ENST ID: ENST00000281932
  CDS Start-End: 119-589
atgcgcagcgcgcgctctacggcgctgaaccggggcgagcagagagctgtcagatactatagccatatgaagttgaacatggcagaagaagaggactatatgtctgattccttcattaatgtccaggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttccctccatccaagcatgaagaggaggggaaaagtattcccctcaataaggctgatgtcagaggcaatgttcgaccagtactactaaattctaatccatttaactgtgataatttctggtaaaatcatgagttttcatgacaatgtctatatccattatatgtgatctgttggaagttttggctagagaaacttaattgtgaggaaatttaaatattgtgtgatgcaagtacttactgaatttggaaaccccttgatagcattcccagcaagtgatagttcaacctttgcttttattcttccagccacagagaactcactgctttaaaaccattccattactgggtagctctgaattgttttcattgttttctcttaaactgaaatctgcttccctgtaatattaatgaatacagctaaggacataccgtgtggcatactatgagagagctccatccagggtgaggcatcaaaatcatgaacctttttaaaagttcatatgctcaggtgtctctcctagtgattgattttgatttgtcttggctaaggtggttcctggatatctatatatttattttgaagtcccaagaatgagtgataagcacctgaggataagaactagtactgaggttaaggatggagcaccaccattctttggatagagttgtgatcacctgtgtgattttatagctcacctgttagttagattgagcaagagaacaaccccttttattagaaacagcatacataagaagattgtaaaaattaacctacacttgctagggtaagataatcagtagtacaatttgtattaatctctgacctaatatgacctaattcacttttcaagtttaacttggggagctttacaaaatagtaataaaagggtcccatcccaagagattctgatgccattagtcactgtgacttgggcatcactgcccttgattctaaaatgcagcctaccttgagccactaatctagttaacttctgggcctcagttcttcatccagaaaactaatcattatttttatgaatgtaaatatgtgtatatatataatatttatatgtttggatgctattgtttaatatttacttttttgtttttaaaaaaattataaaattggctgagcgcagtggttcactcctgtaatcccagcactttaggacgccaaggcaggcagatcacttgaagccaggagttcaagaccaacctggccaacatggtgaaaccccatctctactaaaaatacaaaaattagctgggcgtggtggcattcgcctgtaatcccagctactcagaaggcggaggcatgagaattgcttgaacctgggaggcagatattgcagtgagctgagatcatgctgctgcactccagcctgggtgacagagcaagaccctgtctcaaaaaaaaaaattatatatatatatgtatgtatatatatatatatatagagagagagagagagagagagctattaataaaacagaggagtacattttacccttgcaattccagtcaatactgtggtgtcatttcagccaacataccaacattcagtcaaatcccaaagccaaatggataatttcagatggaatggagttagacaggaactggcttccctttctcctgttactatgaggacaacccacacctgctcagtggcctaaaatattttaaatatgttcatgacaattatgctgagaatgccaggataacactgatggaacccatgacttcaccaggattgtggtctacatttacaggcctagtactagaactagaccggcttagagagtgggagatatccctctgttgtccatcgaaagataaaaatacaggctttcagccgggtgcagtggtgcatgcctttggtcccagctactcagggggctgagatggggaatcctttgagcccagaagtttgaaaccagcctgggcaacatagtgagagacctccatcttaagggaataaaaaaaaaatcagactttcaatatgagtaacaagttatttttaggccttttatgactttataaataggcaataatgaacaccaagggaagcaaaacactgaaaagaattttaaaatttgttgtagaacattaatacgaaatttgaaactgcaaaacaatgtaaaatttaatgtcatgttgtcatttacttttgtgtatattgtgccatgtttattttcaaagtcctatctagaaattctaaaatgtctaattttcttaattaaaaatccagaattctgtagtttctgaaattcaaaataaatactttaacataccaaattggtttttctaataaacatttatttcaagtgtta

SEQ ID NO: 135775 - DNA, 3906 bp, Homo sapiens
  Payload ID: 6542
  Gene Symbol: GPATCH11
  Gene Name: G patch domain containing 11
  ENST ID: ENST00000409774
  CDS Start-End: 68-925
aatagagtctgcactaggaaactggtgggagccgaggtccggaagtccgacgctggtcggtgggcgcatgcgcagcgcgcgctctacggcgctgaaccggggcgagcagagagctgtcagatactatagccatatgaagttgaacatggcagaagaagaggactatatgtctgattccttcattaatgtccaagaagatatcagaccaggattgccaatgctaaggcaaatccgagaagcccgtcgaaaagaagaaaagcaacaggaagccaatttgaaaaacaggcagaagagtttaaaagaagaagaacaagaaagacgtgacattgggttgaagaatgcactaggctgtgaaaacaaagggtttgccttgctccaaaagatgggctataaaagtggtcaggcacttggcaagagtgggggtggtattgttgaaccaattcctctcaatatcaaaacagggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttccctccatccaagcatgaagaggaggggaaaagtattcccctcaataaggctgatgtcagaggcaatgttcgaccagtactactaaattctaatccatttaactgtgataatttctggtaaaatcatgagttttcatgacaatgtctatatccattatatgtgatctgttggaagttttggctagagaaacttaattgtgaggaaatttaaatattgtgtgatgcaagtacttactgaatttggaaaccccttgatagcattcccagcaagtgatagttcaacctttgcttttattcttccagccacagagaactcactgctttaaaaccattccattactgggtagctctgaattgttttcattgttttctcttaaactgaaatctgcttccctgtaatattaatgaatacagctaaggacataccgtgtggcatactatgagagagctccatccagggtgaggcatcaaaatcatgaacctttttaaaagttcatatgctcaggtgtctctcctagtgattgattttgatttgtcttggctaaggtggttcctggatatctatatatttattttgaagtcccaagaatgagtgataagcacctgaggataagaactagtactgaggttaaggatggagcaccaccattctttggatagagttgtgatcacctgtgtgattttatagctcacctgttagttagattgagcaagagaacaaccccttttattagaaacagcatacataagaagattgtaaaaattaacctacacttgctagggtaagataatcagtagtacaatttgtattaatctctgacctaatatgacctaattcacttttcaagtttaacttggggagctttacaaaatagtaataaaagggtcccatcccaagagattctgatgccattagtcactgtgacttgggcatcactgcccttgattctaaaatgcagcctaccttgagccactaatctagttaacttctgggcctcagttcttcatccagaaaactaatcattatttttatgaatgtaaatatgtgtatatatataatatttatatgtttggatgctattgtttaatatttacttttttgtttttaaaaaaattataaaattggctgagcgcagtggttcactcctgtaatcccagcactttaggacgccaaggcaggcagatcacttgaagccaggagttcaagaccaacctggccaacatggtgaaaccccatctctactaaaaatacaaaaattagctgggcgtggtggcattcgcctgtaatcccagctactcagaaggcggaggcatgagaattgcttgaacctgggaggcagatattgcagtgagctgagatcatgctgctgcactccagcctgggtgacagagcaagaccctgtctcaaaaaaaaaaattatatatatatatgtatgtatatatatatatatatagagagagagagagagagagagctattaataaaacagaggagtacattttacccttgcaattccagtcaatactgtggtgtcatttcagccaacataccaacattcagtcaaatcccaaagccaaatggataatttcagatggaatggagttagacaggaactggcttccctttctcctgttactatgaggacaacccacacctgctcagtggcctaaaatattttaaatatgttcatgacaattatgctgagaatgccaggataacactgatggaacccatgacttcaccaggattgtggtctacatttacaggcctagtactagaactagaccggcttagagagtgggagatatccctctgttgtccatcgaaagataaaaatacaggctttcagccgggtgcagtggtgcatgcctttggtcccagctactcagggggctgagatggggaatcctttgagcccagaagtttgaaaccagcctgggcaacatagtgagagacctccatcttaagggaataaaaaaaaaatcagactttcaatatgagtaacaagttatttttaggccttttatgactttataaataggcaataatgaacaccaagggaagcaaaacactgaaaagaattttaaaatttgttgtagaacattaatacgaaatttgaaactgcaaaacaatgtaaaatttaatgtcatgttgtcatttacttttgtgtatattgtgccatgtttattttcaaagtcctatctagaaattctaaaatgtctaattttcttaattaaaaatccagaattctgtagtttctgaaattcaaaataaatactttaacataccaaattggtttttctaataaacatttatttcaagtgtta

SEQ ID NO: 135776 - DNA, 3218 bp, Homo sapiens
  Payload ID: 6543
  Gene Symbol: GPATCH2
  Gene Name: G patch domain containing 2
  Uniprot ID: Q9NW75
  ENST ID: ENST00000366934
  CDS Start-End: 112-1242
ccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggctacaaactggaccagtgagattcccctataaaccaaatcttctaatgctaataaattagttacgttttgaacatctggggaatgacattcgagggaacctggctcctgtcctcttccctggaggaatatcattgaagtgagagcctctttgatgaaaagatggggctgtttttgctggaggactggtattcttccttttagtcagaagtgaacctgactggggaggctttctagggatttaggttggcccagggtggatagaaactactgtaaattatatatttttctcttttatggttttttttttacattgaatccatttatgtatacttgctttgccaaaatgctaacaaagctagaaaattttaaacttccagatcgacaagtattccttaatgtttatattgtgactgattaagaattaatttttacatatctgactgttgtaaataaaaatcatgatgcattgacatttatggttcatttttagagaagtcttatataaccagcattatttaaaatatttgcattttactcagggtattttaacaagggctaagatgagtagtaggtaaggttgataatctttgctggagtttgtattttgttcagcttcctttctacttgggtaatctgcttgtattgcaaactcattgtattttatagtatagctttcattgtactgcaaaaatcatcctcgttttaaattagccacagtgataactagtctgcactagtagaatcatttaccttttaaattatctgctttgtctgatacctgaaacacatcaaaattattattttggtttagagcttaatgaaacatgtgaaagctggtatttttaacaaatgctgtgtgattctgaatcatattgtcatgtttaaaagtgagagctgcttgtacatctttagaatggcagaccatatgtgtcactgtgagtgtcagaaatacttgcatgagctcattttcaccaactggggggaaaatgtaatgtttctattgatggtataatttagacactataataagttcagccatttgagttcttcaaaatggttatattaaaatgatatttttattaagcttcaataatgaaaaacaatgtgatttaatatgtgtatttttatattattgtatggattaattgttaattcagcatttaatggctaacttaaatatgattggaaaagaaacttcaagttgccattgcttttacctaaagtttttaaagtctgaaagatttcagcaaatgcattaaacaggaatgtgtgacatcttcttttagattgcttgtctaatttggagagattaaaaatggtaaaatgcaactttgagtctctttacctttgcatatttaaaggtacaatagtgtggtgttggtaattgtaagtaagcttttctgtgctatgtctttggagtgaaaattcatgttttttttctgaattacataaatgcttttgttttattttgtataatgactgtcttttagatctgaataagtcactttaaaaccttggcctatgaactttgccttatcaatcatgaatctagatgaatgctatctagttcttggttcagttttacctatttttatttttggttcactgcttgcttgagcatagctgggatttgtagcccattttctaggcttattgcaatctcactgtggtattttatagaagctattacaactgataggctagcttcatggtattgatgatacatggcttaaccatactaaaagctgctttccctctctaaattgtaaaaaggtgatgaagtttcacttgatggagacatactatatatgtgtgtttatcatggaactagtgcattaggccataagctgtttttctggtctatgttttttgtatttaaaactttactgaagacaatggactccttcgggttttctttctttcaaccctgaattgtccttgtttgaatttttaagtactgtaatttttttttttcaataaaatctctgacttgggcaagaaaggtaa

SEQ ID NO: 135777 - DNA, 5851 bp, Homo sapiens
  Payload ID: 6543
  Gene Symbol: GPATCH2
  Gene Name: G patch domain containing 2
  Uniprot ID: Q9NW75
  ENST ID: ENST00000366935
  CDS Start-End: 112-1698
ccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttccttactgcatacagtcctgccatagtgagagaaatgggatttcatcacaattcatggtgctaaaatgaaaacctctgcactttaatttttttcagtaatttccagctatttctaggtataaagagcagctcgtttctcttatttattttagtctcatgtgtcaatactttccgatgctttgcttaattcatgtatgtgtgcagtgctgcaatgcccagacaaacgtgagcacacccaccagtttctaaaatggaatagacaggaaaagattgtgttttatatcatccctatctattgtaacccaaaagacctaccatcgcatcagtgaagtccgaacacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcgttgttatcaccagagtgccctctaccttactttaatgcagattttataaattttacctcatttagaacataaaataattattgaaagaaaaatgtattttttaaattcaccgtgattgaactgtaaattctattaatccagatgtacttctacctctgttttcccaaagattgatattatttttaagatcaactcaagtgtagtaaacggatttaaaattttaatcattggagtaatttattacaatattgaatcaatttacatgaaaagttaaatggctctcccagaactcagatttctggcaatgacccaacccatttagaaggtgaacaaaagaagtaaatggtactgatttgccctttctaggacccaagatgttactttaaaacctagcaaaagaggtcgtttgtattacgtgcctagtattgagctgtttctgagtcatttgcttcatagtatcagaaattctaaattgcttttagtttagaagatctttatttattatcttcattattaacaacttattatgatgatgattattatcattctatttataatggcctttgctggttgagtaaagactgagataacacatgtgaatcacctttctaatgggtttttaaaatcttgtcactttccaaaagagtttttttgtttctttttttttttttttttttttgacagagtctgcctctgtcgcccaggctggagtgcagtggcgcactctcggctcactgcagcctccccctcctgggttcaagtgattgttctgcctcagcctcccaaatagcagggattacaggcacccacgaccatacccggataatttttgtatttttagtatagacggagtttcaccatgttggccaggctggtctcgaactcctgacctcaagtgatccgcccaccttggcctcccaaagagctgggattacaggcatgaaccacagcgcccagcccccagaagagtttttaaaaggtgttaaaggaggtttatgcacgtaacagacctttctcaggtggtcccctaaaaaaaatcctgccaactagggaggggaagtccaacctgctatttgaaagccttcacggtttgccaaatgtacatttcttgagaattatcttctttcccagggatattgtacctagaggacaggttggttagggaactatggacgaccagaagagatgttcttttgaagcattcttactggataaagtaaccccatggtatcattactttctacaagttttttacttacaaatttgccatttttttaactgatattttctaaatgctcattctgtctatgtagccggggggagattatatacaagttttaaaacttctttgtgatagtgtattgtgctctggggtctattcaaaatttggtgtttgaggttttgttaatttgattgcctggagatctgctaaaatcctagaatctcaaaaagccaagtttgaagccactgagagcaaacaatgaggtcattgttagcctggttccacactcctgaggacttggctgttctttttcaccttattatgttctaatggaagtaaaaaccctcatagtgaagaagagcagtatatacaccagactagtgtataggaacttcttcattaaatattgcagtccttatgagtgctctttattgttgctgttctggacaggtacaaatcttctgaagcaacttctgtgggatgttaacttagcttctctaacacctaaaaaaattcttctttgtattttcagctaatagaagacagttcttcttcatcttgacacctagagccctctatgtgattcacagaggacttaaaatacttcttactctgttgaagtgtttaattgtacagaatatatgtactctacagtatatgtgaatcagcactcaaagcagagaagtgataacatcccaagcttcccccatacttctactgacatgccctcagtctttaagaaaactcagtacagacctgatgttctggttgtacctgaacttaattggagaaacaaacgcaattaaaatacgaattttttagtgcaaatcaaatgtctttcaccatctgaagcccactaatttgtcttttatatatagttaattttttgccagttacaacgtccatagaaccccaagatttagaatgtatcatttatatttcctctaaaaggtagtaagatatttcttctgctgttttgtgaagccactcttctacagtatctgtagccttatagcaaattaattggttgtactaaaaattttagagactgcataggtctcccttttctatcctaattacctgcaatagcctagagacgctgagcatgattacattagcaacttgactgtttaaaaaatttgttatacttgataatgaccagactgtgtgctggagtcatttgtttccttcttttctgctccccgaatacactatttaatttggttacttttatttttaaactatatggcacccttttaaataaacattcattgctaattaaaatctgccaataaattggtctcagcatttaaataccatatattttataactcatactgtggctatcaaacagaagttaacacagtaggggtaaagatatacataatgtgtacctataggtgtatttataatgcctgtgtgcagtatacagacataattacaaaatactgcattttattaatgtttattttaatattgagaattggcattcttgtaaattgaactgacaattgcttctattcagtacactttattttgagcagatatttccgaaaagagaaaaaatcactgttgacatgctttttaaaactgttttcacctgtattttgtctttcaaaaagaaaagtgatctaagttggcattgtaaagaaattgttagcaaagaatatttttttttattttttcttttggtagaaagtcatgttaatagtacaacaaagaatcaaagaataaaacataatgtttaagaacattatttataagtagtcattgtctttgtgctttaaatgtttcccttttaccttagagttattttttaaaagttgaaagtactttaaaaattggtttaaatgagtacccattgacaattatcatttaatagtgcagttaagttcagcgaaaaatttcaatatctcaaaaaaattagagaaaaatattggtaaatgtatttgattcacaaatgtattcatagccgattgtgagctgctctaccacattttcctgtttttattgtttctgtgaagcttgattagactaacttgcttaaggtctctttcccctcaaggattctgtgattctaatgtaacaaggtacacacgctctctctgaccacttaaagtatcagagttcaaatctgttacaatcactccatttccttttggaaagttgtgcctctcataaagctgcttggacattttaagtgttttgtaatatgcattgaagtgttgagttttgtttgctgtaagaggcatttcactatgttgattaaacttatcttttctcccaaaaaa

SEQ ID NO: 135778 - DNA, 14007 bp, Homo sapiens
  Payload ID: 6544
  Gene Symbol: GPATCH2L
  Gene Name: G patch domain containing 2-like
  Uniprot ID: Q9NWQ4
  ENST ID: ENST00000261530
  CDS Start-End: 67-1515
cggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagaaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgcctttatacttggcgtgtttatgatggctcagctgcatgtggagttatatatacagtcgtgcctgaagttggatgctactttgtcaaaatgagaaataagtgatggcctggagctgctggagagaagccacgctttctagaaaatattatcaggagtgtctgtcattcattcaggggcctagctgacagaagggctcttttttttataccaatgagtgcgtttactctgaaatacatagaagctcttggtgaagtgctccctgctctggtcacattgtagagggactcccactcatgcatctgcttattttctgtcttaaataggtgctgaatggggcagcacctccttcccccaaagtgcgattgcccctgtttcccatacgaagtgtaatgacgggttgcttttaaaattatagtccttatcaatggaaactccagatttctttatcaaagggaggtgggtgggcatgaatctagttggaaaaggggacttgaagctaagtttacatggcactttaagactgagaacatatcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgcttacagggacttcccaggctgcacttcccttccctgtgggctgcacccgtagaagtatagaaaatgtaatgtctgttgaatataaaatcgtaccactgaattgttctagtgatgaggttagattttgttgtcatgtgcattgtcaccatagtgacccgtggcatatatttttaacatacttggttgggtttgagagaaatctgtggacgtaattttttgtttgtgtcaagctctatgactcatgcagtgattggtcccatgatcatggcctattagtgaaaacctccaaaggtcaggtggccaaggtgttcccacattttttctatataacttgtttcctaatagtctgcctttctacctatgattaaaaataatttttatatacaacattatttacatttcaaacatctctacgaagtcatgccattttaaggagatgaaaacagccacagagttgagtgacttgctccaaatcacataactaagccaggactagaatcccagactttcagattttctctgccctgggttataatctcttgtttttcagtgatagacctgagtcagtctgagatgcttatttatgaaacagtataccatgaatatttattatctttcttgggcatgcttttctacacattttgaatactttcaacagggattacccaagaatgcaacatctacctgtaataaatggggagaaaattagttgcctgagagaacagaatattaagcacacaaatactttccaacacagggttgtaaattgtgctcctcattttaaggtgctgtacgtgcatgtttaaggaattattaatcagtgtattctgcttgctttctgtattaaccagttccagaggatagccttagaaatgagtgtattttgaatcttaaagtttctttatatgcggcacagtgtataatgtcgtaagttaagaaaaatctgttatctttcaaagaagttacgtagtttcaaaaatgaggttttgtaatcagtgttgaaaaaactctgaactatgacttactttgaggatgatccttgagctcatgtatttgatctgctcaaaagtaataactaaagctgagttaaacagttgttatttatttcagggttctgatttttcccagctggctacacaaatggcctgtctgaatcctagtttagtgtgttttccacgatgggcagaagtcagaacattatctgcttctgtgaggatcataataaaaagttagttttaattacgagtttaaaggaattttagatttttttcagatgcagtattttaaaggaacaaaactcctgtgttgccttttgttgttgttgttgttgttgttgtttcctagagacaggttcttgatctgtcactcaggttagagtgcagtgatgtgttcatagctcactgtaaccttgaactcataagctcaagccatcctcctgcctcagcctcctgagttgtgaggactatggaagtgtgccaccatgcctggctaattttttaagtttttggagagatggggtcttgctctgttgcctatgctggtcttgaactcctaacctcaagcaatcttcctgcctcagcctccccaggtgttgtaataataggtgcgagccaccatgcccagccttgtgttgcctcttggtaagaaataataaaaagaaattagtagcttgtttacctggtaccagatttggagggggctgagtataatttttactgagtggtatgtggttggaaaataggccacatttagccttgaattgtttagaaatcaaatgcgattcagaattgaagaggacattgctgggctatgaaatagggtactaacaaggctatttttgtagcaaaatggccaaaagctgaaataaatcttcttagtctgtgatgcttgtagcatcctttgttaagtaaagcacaacaccctggacaagcgactagttatgacttccaaatagattgataatagccttgcatgttgtagttagagacactgtagctgtatctgtatacctgtaatatagcctgggaagttctgttgctgcagagttatcattaaagtcacttggaattgaaaaagatacagagtgttgagacaaaggaactaggctggcacagtcattgctgatgcgatgggttctccactttggctccaggcgaaggctcctggtggtgatgcatgattgatttcaggtctttgtttcattttggcttcattactgtgattctgagccacacaggtttttccccctggggagaagactatgtaaaaatctcagcgttagaagctgtgttcagtgccctatatgtcttgtgaacctatctgagctgggctgagagcagagtggcttactgtagcagctgtggatgcagtctagttggaggcatggcttggaggacgtcatggttcatgcgatggttggagggatggtaaaagcagttagctcttgtcagctgcttccctctgctagtgcttgagctgccaattttatttgtcagtatttcctgatctcccactcctgttgtgaaaggtcacagagttactgtcactggcaacaatttcgccccttagaagaaaactggtacagagggaaagggtgaggaaaatggtgagttccatcactcagaactaaatgcaagtggtagagagatgctttctcctgtgttaacgtctccaaaagatgaacatcaaatgcccggaaacagcaacatcaaaaagaaggaagatgagaagtattgttgaagagtatggacctacagggtttttaacaagtccagcaaaacaaactatggccaaaagaagaaatttttctgtcactgcgagtagacatcataaatgcttggtaaaattgccagatttagggaataaaaaatttttaaagtacagtgttgaagaatggggcatgtcatgaagacattcagcaaagaagcaatcttggcaaggtggagaagtgggaagcaatggggagagaaagggagatgcccagagcaggaattctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtataattctttgcagaaactgttaatgtctttatttctcatattttttttttcccctacaagctcctgaaagatctttttgaagaattgacaaaggatgctatcaagggctatgtttaggtggatggaaataaccttttgaaaatggataaagcctgggtgtggtgactcacgcccataatcccaacactttgggaggccagggcgggaggattgctttattgcaggagttgaagaccagcctatgcaacacagtgagaccttgtctctacaaaaaattttaaaaattagctggctgtggtggtgcatgcctgtggtcccagctacttgggaggcagaggcaggaggatcactcaagcccaggaggttgagggtgcagtgagccatgatctggccactgcactccagcctgggtgacagagcaagaccctgtatcaaaaaatagataataaaataaaaattgataaaaatagatcaatgaattgttagtctacgaatgatagtcatttttcacaattggcagtaaaaataggatttgtgtaaggtatgagtttaccatatttgttcattagatcttagtttcaagggaaagtatcatgtattttccagcatgataatgatgaatcatttaaagtacggctcataaaaatgaaaaaaaaaattggaagaaaaaaacaccttgggtacatagatgtgtaataaatacctgttgagttattggtaatctcttgctaggactgaatctcagtacttcagagcatgtaaaaatcaattttctgtgatcccacttaatcacaccgtgttttctttttttagatttcagctagcaattttgcaggggttggagaccaatagcgatgtcatgctttttggttgttgttattgtctgactcgtggattcagcatttcagaatatggtactctaatcttaaggctttgaaaagaaaccatggccattttttcttcatattttacctttattaattgggctgggtcctaactggttgccagagcccagaaatccaagttctgtcttttcagggaatatgcatagctaaagagttcattgtgtttgcaaaggtgtactaggagttctcatttcctcagatgctcatgtctgtaggctgttaagctctcatttcaatttttgcagtcttttaaaacaccacacttcttttccatcttgaagaccagttaaaactacctctggccaaaaatgttagtgttactagatattatcaaggtgtgagactaaaaagttagaaggctttaagatgtaaattatataagttaatgttttctttccctaaaagttctgacccttgctgacccctcaatcaaatgtttttaattgaaaggggaaagaaaatatcagagaacttaaagatggccttcgtgactttgactcaaaatcaatgcatttcattatgtatgggtcctacaccttgcttcctcaagtggccatgaaaaaaaatctcacgaccatgcaaactgatgccaccccaaagtcatggtaacgatttgaattgctctcagtattgatgtcaaactccctcctgttgtcagcagcttattgcaaactggccattctaaacccttttacccccaccttctctcaatcttagcagttaatctcagccctcccccaccacataacagcctcgggcagaacttcccacttagacacccacacacacacacgcttccttaccttcttgccagtgcctgtcctgcccaagacgaaccccttttcctgtgccctaggacctctcccttgataaatgacttgatctagctacagcctcacactcctggcacatacagctttgcatttaaacatgttcagatactccttccttcaaacaaaagacctttcctcaaccctttgaaagcctgagtaccactaaggtatactgcccttatctgcactctgtccattctgcagtctaccgaggcagtggtttttaaccctggctgcatgttagggtcacctgggaagttttaaaaagtcctaattcctggactggaccacagaccagttaaatcagcatggggaggtggggatgggtttcagtctttaaaaagaaatgtagctgaggctgagaaccaccactctaaaacctggctgctacccttgctaccattaaaactgttcttgctggattcacccaccagtgacttctactattaaaatttagcccataggttgatttttatgacactgatgctatataaccacttccttctttggaatgctccctttcctgaccctactttcctgatttttctgccacttctttgctctttctcagtttctgtggagttgtttggtaggtcagtctagcacagactggatgccggtctctgccgccacctccgttatttcagtgaacacctgtatgccagtgagttcctttgccataccaccttaatgcaccaacttaaaagcacagattagagtggagcattcacatttattactgcaggcttctaggaaagcatattaaaggtctctggtccttctctcacctcccttgttcctcctccaagcccagtgaggtaggaggaattgctaattagattagtgagattctaaggtgggtcactcctgtttacttatgagttgctatttatgaaaagatggcctggactgtgttccctcttctgctttctcctcttccgggtcttggactggtaagggggcctgtgcccaaaaggggctcctccacctaatgctgtctttaatctgtggctttctgctgctggttaattttttaatttggcttcctcaagcctttttggccttgaacttcatgttgatttttatcaaagaactttttattggggcatcagcactagccctatgaatacagtgaaacttggggttccactttcatcagatgtgaccctgtgtgttcctgatgtctttgaatcactagtttctgattcaaaatatggggtaggtggatctgattagtagtcatatgcctgtgtcctggctaggaagtcagaatgaggttatctggaaagttgagcttcctcacacatgggaaggtacttcagatgctggacagccaataagaataacaaaggtccaccagaaccattgccccagtcactgattgaacaaacatttactgaacactgatgaagcgaagtcctcctcagggacctcttagggaagagggtaactgccctaaagcaggatactcctgggctccttagatatactatccttgaaactattaggcccctgtccagagtacctaataataataatggcaaatatgtatttggtggtctgccatttggaagcaacatctcacttattcaacaactctaaaggtaggtacttttatctccattttaaaacaatgaaatacacttacagttacagacaaacttgctcgagtcacatatctattaagtgtcagtcaagattcagattcaagtctgatgttaaagagtgtctgttcccaatcaatacctctgctgcctctttttacaaactgaactgttggagggcatgtacatatgcataagctgtgggccactgggccatgggccagtgtctgatgagacctctttattgacttgtttgtcctggtgggctgtttctctaccaggcaactgtgaatgggctcatcccttctctgtgcgtacatgattgaaaggagatagccggtttctgtgacatcctcttataacaacctagttttgttcttgagagtgaccagagcaagagaaaagtcaatgaaattttgcagatcttgcaaacctgtggcaataagaaggtattatcctttctgtaccaaggcacaactgattcctaagtgagggggatatgtgttctgagatgttaatgttagtgatagactgttttcaacaccttggtaaacatttcttttgactgttagcaaaagctgccttaacagtcttggcttttagaaatgccccttcattcattagatgtgtatggaacacatcttatgccaagcactctgctaggagctgggtatacagagaagaaaggcattcctgctctcatgatgttcatggtcttctgcggaagagaccagaaaaaaagtattacaatgtagaatgaaataagaatgacagggtattttggcagcaaggaggagggcactttaactcaaactgggcagtggaagaagtaaaaaaaaacattgaaagaaatcctgaaggataagcaggagttaagaagagtggatgaagccctccaagggtaaaagcatggtttattcagagcactgcaagtgttttagtatggcccacatgtaaagcttacagaggaacaaagagagaaaggcaagagccaggaagtgaagggtcctgtgtatactggcttacttgttgagttggagaactattgccgtattcctctgctaagctcagggtgcattcgtggaaaccctactgcaactggcccattgtgcatacaaagctggaactgagatgtgaacagatttgcattgccttgatcaccttccgtgggaaatatagctaggcccacttattggtaggagctactgacatgttaaaactaggttaaactgaattggaagtaatggtgtatttggaatcatggctgactgattccattacatgttctagcatgataccagtctgaggttattccccttgaaccaccgacttagtagagtttaatgcacaatgtgatggtcttagttccttgtactgttcttcagtgtcaaagttgttcaactaccagttaagttttttgggctttgtttctcagtagtgacaataaatttgtgttgatctatttacaccttttggactgaacaccttagcaatcattgatattttaagcctacaggaagtgcccatgggataaaaccaatctgctggctcacactaagttctgatcccatgattttggtctcattaataccgtgctataaataaagttagctaaatcttttgaaactgcataaaagtgaaataattatgagttttgggccaacatttttcctgaacagcttctgactgaccagcattttaaattaggcgatgcagtctagcttttgtacatagaaataagaaagtgacttatgttccattattaaaatagtatagggaggacaggtaaattactaatttttcattgctcatagtagagaattaaggtatattgactagtgaaatagaggattatggggatcatatgaaaatatgattaaagagattatcactagaagaaaaattcagactgctaattatgagaaaaaacatgtatgcacaaccaaacaaatcacaaaaatgaaagatgtctaaaaccatagaataggaacaaatgtacctgtcatattaataaaagtaaacttatctgtagataaaaggcaaaaatgtcagcaaacactaatttcatgttataagattcagaaaggttgagcaaaagtaaaccaagcaaacacaaacaagaaaatgagttgtagtctgcatatcaggcaaggttgaacttagggaaaaggaaccggaaaaaaaaaaaccaaaaaaaaccacgacataatgctaaagggtgtgactcacgagataatgtttctagatatctgtgtaccaaataatggaaaaccatttatgtattggaaaccataggagacacaggaagaaacaaatacaatgttagttggatattttaattcaattctgtcaattcatgacagatcaagtggataaaaaactaggacatgggatgatttaaataagatacagaagatctagttgatgcatattagactttaccctaaaagtggtaactacacttcaaagtatccatgaaacatttccccatttgactgtgtattagagcgtacagaaaacataagtttcagaacggaaaaaaggaacaacagatggcatttgctgataaaaatgcaataaacttagaatttgaggataggtggtcagaaaaaaaaatgcaataaattaaagccagaaaacactgctcatctgcaatccaaaatgtttttaagctcttcaactattcttgggttgattaggaaatgcaaagtattaaaaaaacatttcatatctaaaatataaacttgttcctctgagatacaaataaaacagtgctcagaggaaaattcattgccctaaaatttatgtattaaaaaataagataaatgtcatataactcaaaatattaggaaaaggaatcttttaaaggcaggctaaaagaatcaagaaaaattaattagaaaaatgaggaaacaaagctaatttttaaaatatgtagtaaaatatgtaacattttagctaacattacaagagaagacaaacacaaaataagaattaccaagtattgaataggtaagagtcataaaatattctttgctcaactgtatgcaaacaatttaaaaacttggattaaatggataattttccaggaaggtatagtttgccaaaaaatgacatcaaaagaaatctaatataacaattgtcatagaagaaatgaagtaagtatttcaattagcatgacagactaaatacttttaaagacccaatgaaaacaaagaaatgcatttggagaattaacagaaactttttgtaacaccaattttttattttacattttaaagcatggaatggaatttattgtaaagacgtgtattttatagaatccaagcaaaagctcaccagccagagataaagtgaggccagctcagggaatgtgagcagtggcgatttattccctctggtgttccatgttagcctgacacagagccccctcttcacattctcaggggctcttgatccaaaaccttttttaaaaaaaataattttagacttaacagaaaatctgcaaaaatagatttcctgtgtgcccttctctcagcttcttctaatgttaacttacataccaatggtacaattattgaaactaggaaattaacattggcacaatcctattaactacatactttatttgaattgtagctgttttcccagtaatgttgtttttctggttcggtattcaatccaggatccatatgtacttgggtctttctgggttttctgttccactggtctacttgtgcatggtaccacactgttttaattatagagactttatagtatgttttaacaactggcaaggctagtcccccttataatttttcctattgtgcttctggctattcatacatgtttgtttttccatgtgaactttagtatcaacttgtctaaattcattttttaaggtacattggtattttattgatattatatgatattaactgatttagagagaactaacatctttaaaatgtggtgtcatcctatccaagaataggagatgtatttccatttattcaagtctattttgtgccttttagcagtgttttaaaattatccttgtgtaggttttgtgcatttcttgctaagcttatccctaagtatttaatttatttgctagta

SEQ ID NO: 135779 - DNA, 2438 bp, Homo sapiens
  Payload ID: 6544
  Gene Symbol: GPATCH2L
  Gene Name: G patch domain containing 2-like
  Uniprot ID: Q9NWQ4
  ENST ID: ENST00000312858
  CDS Start-End: 68-1501
ccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgccttt

SEQ ID NO: 135780 - DNA, 529 bp, Homo sapiens
  Payload ID: 6544
  Gene Symbol: GPATCH2L
  Gene Name: G patch domain containing 2-like
  ENST ID: ENST00000557207
  CDS Start-End: 159-344
aagccccggcggtgagagtcggcccaaaaagcggcggccgttggaggtggctgcggcagctgctacccgttccttcctgtgcgtgactcagcctcatctctgcccgggtgcgtgcctggccgccgggtcctctcgagagtgtgcatccgcgactggagatggggagttctagggttcttttgtcactactgttggaattacaggctttgaggcaggaaaggattctgcacaggcattcgactgcaagttgtttgatgacttcgttccatgttcaagtttgtgctgttctgcctgaggtttttatttgttcttttgtttttgttttttgtatttttgttgcctgagtttttaaagcagtaattctttattagggaagtagattttgacatgctgttcccacttgtttctttattttggtcttagggacagttgtctcccaaacctcaatcatggcattttaatccacttttttttttcccattttttccccttcttttcacaggtgttgataaaccacttcttaatgctt

SEQ ID NO: 135781 - DNA, 575 bp, Homo sapiens
  Payload ID: 6544
  Gene Symbol: GPATCH2L
  Gene Name: G patch domain containing 2-like
  ENST ID: ENST00000556109
  CDS Start-End: 84-575
gtcagagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggagaatactccctggacctcatcaggccacggattgtgtgaatcagcagaaaataggactttcctaagcaaaacaggaaggaaagaaaggatggagtgt

SEQ ID NO: 135782 - DNA, 2112 bp, Homo sapiens
  Payload ID: 6544
  Gene Symbol: GPATCH2L
  Gene Name: G patch domain containing 2-like
  Uniprot ID: Q9NWQ4
  ENST ID: ENST00000556663
  CDS Start-End: 719-1774
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatctttctggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcatt

SEQ ID NO: 135783 - DNA, 821 bp, Homo sapiens
  Payload ID: 6544
  Gene Symbol: GPATCH2L
  Gene Name: G patch domain containing 2-like
  ENST ID: ENST00000554799
  CDS Start-End: 657-821
agtagcttggatttctagtgtcaagatgatttctgtcccattaatgagataccaacgataaatgaagtatggacatatattctttattcaccttttatgataaaggcaaatatagcaagaaatccctcaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagaaaagaataaagcgttggcttctgattttcctcacatttctgcttgtgcacatgagttttgaactttgcagtaagaaagcagaatgaatctgatttgcatatggtttagttcaacatcagaatcctgcgttgagaagtactatgttgaagcctaaacgtatggagcagaagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcaggtgattacatgcagt

SEQ ID NO: 135784 - DNA, 1458 bp, Homo sapiens
  Payload ID: 6544
  Gene Symbol: GPATCH2L
  Gene Name: G patch domain containing 2-like
  Uniprot ID: Q9NWQ4
  ENST ID: ENST00000557263
  CDS Start-End: 65-1120
agagagggaagccccggcggtgagagtcggcccaaaaagcggcggccgttggagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcatt

SEQ ID NO: 135785 - DNA, 539 bp, Homo sapiens
  Payload ID: 6544
  Gene Symbol: GPATCH2L
  Gene Name: G patch domain containing 2-like
  ENST ID: ENST00000556372
  CDS Start-End: 1-94
ttcacgtgacatcaagaggaagcggaaaccagtggccacagcatctttgtctagccccagtgcaggtggtagaaggacagcccccctgccctgagacaacactcggaggcctgtattccagcgagagtgccctgacaagacagctctggccacccttgcctggctcctccaccttcccgtcagtttcgtgagttctccagccttttcccagctggtcattgttggtgaaagctaaggagcaagtaggagttctcaagatgaaatggatgacccatgagaccggtatggttatcattcccattttatacaagaagaaaagaaggctgagagagtttaagtcacttgctaccacatgagtaggttgcggcagagctgggacaggctcatcatagcattgatttcattgtgtcatgaatgcctgttttcttttctctttccccaattcagctgttaactggttgatggcatacaccacaatttttgttgactttaaaaatattgtaaagtatagcacatatacattattaaaagaaaaactg

SEQ ID NO: 135786 - DNA, 776 bp, Homo sapiens
  Payload ID: 6544
  Gene Symbol: GPATCH2L
  Gene Name: G patch domain containing 2-like
  ENST ID: ENST00000553588
  CDS Start-End: 14-316
ctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcaggtgattacatgcagttatcatttattgagcatgtaccgtgtgccaggcactaaattatgtgttttgtataccttttcatgtaatgtttgtgatagtgtaggtcattttattcccactttacatgggaaaactgagactacaagaaataattagcctagttcttgctgactctgaagtctgtgctttttcactgttacatggctatctagagtttgaaaccctatattccactatcagcaatctccagtcatctgagcttttgttttagcagacaggaaattaggtccatgttaatgaaagtccaggtgaagtggcagttcagtcaggcagtcacacagggttatttactttcttattttgcatacagtacagtacattcttactgcttttataagtagaatgctaatattttactggtcatgacattcctaattaaaaacaattttttaggctaaaacttttcagttttttttttttttttttttaacaaaactaacactaattggtagaagccaaaatagtgcttctctttggtggggggcagtgaccaagagagggcacaaagaaaccctctgggctgttggcaatgctccatatgatgaacttggtgggg

SEQ ID NO: 135787 - DNA, 1791 bp, Homo sapiens
  Payload ID: 6544
  Gene Symbol: GPATCH2L
  Gene Name: G patch domain containing 2-like
  ENST ID: ENST00000554375
  CDS Start-End: 87-1184
gaggtcagagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttttgaactttgcagtaagaaagcagaatgaatctgatttgcatatggtttagttcaacatcagaatcctgcgttgagaagtactatgttgaagcctaaacgtatggagcagaagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctc

SEQ ID NO: 135788 - DNA, 446 bp, Homo sapiens
  Payload ID: 6544
  Gene Symbol: GPATCH2L
  Gene Name: G patch domain containing 2-like
  ENST ID: ENST00000557542
  CDS Start-End: 129-446
gtcagagagggaagccccggcggtgagagtcggcccaaaaagcggcggccgttggaggtggctgcggcagctgctacccgttccttcctgtgcgtgactcagcctcatctctgcccggatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagt

SEQ ID NO: 135789 - DNA, 12396 bp, Homo sapiens
  Payload ID: 6544
  Gene Symbol: GPATCH2L
  Gene Name: G patch domain containing 2-like
  Uniprot ID: Q9NWQ4
  ENST ID: ENST00000621494
  CDS Start-End: 11-1444
atgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgcctttatacttggcgtgtttatgatggctcagctgcatgtggagttatatatacagtcgtgcctgaagttggatgctactttgtcaaaatgagaaataagtgatggcctggagctgctggagagaagccacgctttctagaaaatattatcaggagtgtctgtcattcattcaggggcctagctgacagaagggctcttttttttataccaatgagtgcgtttactctgaaatacatagaagctcttggtgaagtgctccctgctctggtcacattgtagagggactcccactcatgcatctgcttattttctgtcttaaataggtgctgaatggggcagcacctccttcccccaaagtgcgattgcccctgtttcccatacgaagtgtaatgacgggttgcttttaaaattatagtccttatcaatggaaactccagatttctttatcaaagggaggtgggtgggcatgaatctagttggaaaaggggacttgaagctaagtttacatggcactttaagactgagaacatatcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgcttacagggacttcccaggctgcacttcccttccctgtgggctgcacccgtagaagtatagaaaatgtaatgtctgttgaatataaaatcgtaccactgaattgttctagtgatgaggttagattttgttgtcatgtgcattgtcaccatagtgacccgtggcatatatttttaacatacttggttgggtttgagagaaatctgtggacgtaattttttgtttgtgtcaagctctatgactcatgcagtgattggtcccatgatcatggcctattagtgaaaacctccaaaggtcaggtggccaaggtgttcccacattttttctatataacttgtttcctaatagtctgcctttctacctatgattaaaaataatttttatatacaacattatttacatttcaaacatctctacgaagtcatgccattttaaggagatgaaaacagccacagagttgagtgacttgctccaaatcacataactaagccaggactagaatcccagactttcagattttctctgccctgggttataatctcttgtttttcagtgatagacctgagtcagtctgagatgcttatttatgaaacagtataccatgaatatttattatctttcttgggcatgcttttctacacattttgaatactttcaacagggattacccaagaatgcaacatctacctgtaataaatggggagaaaattagttgcctgagagaacagaatattaagcacacaaatactttccaacacagggttgtaaattgtgctcctcattttaaggtgctgtacgtgcatgtttaaggaattattaatcagtgtattctgcttgctttctgtattaaccagttccagaggatagccttagaaatgagtgtattttgaatcttaaagtttctttatatgcggcacagtgtataatgtcgtaagttaagaaaaatctgttatctttcaaagaagttacgtagtttcaaaaatgaggttttgtaatcagtgttgaaaaaactctgaactatgacttactttgaggatgatccttgagctcatgtatttgatctgctcaaaagtaataactaaagctgagttaaacagttgttatttatttcagggttctgatttttcccagctggctacacaaatggcctgtctgaatcctagtttagtgtgttttccacgatgggcagaagtcagaacattatctgcttctgtgaggatcataataaaaagttagttttaattacgagtttaaaggaattttagatttttttcagatgcagtattttaaaggaacaaaactcctgtgttgccttttgttgttgttgttgttgttgttgtttcctagagacaggttcttgatctgtcactcaggttagagtgcagtgatgtgttcatagctcactgtaaccttgaactcataagctcaagccatcctcctgcctcagcctcctgagttgtgaggactatggaagtgtgccaccatgcctggctaattttttaagtttttggagagatggggtcttgctctgttgcctatgctggtcttgaactcctaacctcaagcaatcttcctgcctcagcctccccaggtgttgtaataataggtgcgagccaccatgcccagccttgtgttgcctcttggtaagaaataataaaaagaaattagtagcttgtttacctggtaccagatttggagggggctgagtataatttttactgagtggtatgtggttggaaaataggccacatttagccttgaattgtttagaaatcaaatgcgattcagaattgaagaggacattgctgggctatgaaatagggtactaacaaggctatttttgtagcaaaatggccaaaagctgaaataaatcttcttagtctgtgatgcttgtagcatcctttgttaagtaaagcacaacaccctggacaagcgactagttatgacttccaaatagattgataatagccttgcatgttgtagttagagacactgtagctgtatctgtatacctgtaatatagcctgggaagttctgttgctgcagagttatcattaaagtcacttggaattgaaaaagatacagagtgttgagacaaaggaactaggctggcacagtcattgctgatgcgatgggttctccactttggctccaggcgaaggctcctggtggtgatgcatgattgatttcaggtctttgtttcattttggcttcattactgtgattctgagccacacaggtttttccccctggggagaagactatgtaaaaatctcagcgttagaagctgtgttcagtgccctatatgtcttgtgaacctatctgagctgggctgagagcagagtggcttactgtagcagctgtggatgcagtctagttggaggcatggcttggaggacgtcatggttcatgcgatggttggagggatggtaaaagcagttagctcttgtcagctgcttccctctgctagtgcttgagctgccaattttatttgtcagtatttcctgatctcccactcctgttgtgaaaggtcacagagttactgtcactggcaacaatttcgccccttagaagaaaactggtacagagggaaagggtgaggaaaatggtgagttccatcactcagaactaaatgcaagtggtagagagatgctttctcctgtgttaacgtctccaaaagatgaacatcaaatgcccggaaacagcaacatcaaaaagaaggaagatgagaagtattgttgaagagtatggacctacagggtttttaacaagtccagcaaaacaaactatggccaaaagaagaaatttttctgtcactgcgagtagacatcataaatgcttggtaaaattgccagatttagggaataaaaaatttttaaagtacagtgttgaagaatggggcatgtcatgaagacattcagcaaagaagcaatcttggcaaggtggagaagtgggaagcaatggggagagaaagggagatgcccagagcaggaattctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtataattctttgcagaaactgttaatgtctttatttctcatattttttttttcccctacaagctcctgaaagatctttttgaagaattgacaaaggatgctatcaagggctatgtttaggtggatggaaataaccttttgaaaatggataaagcctgggtgtggtgactcacgcccataatcccaacactttgggaggccagggcgggaggattgctttattgcaggagttgaagaccagcctatgcaacacagtgagaccttgtctctacaaaaaattttaaaaattagctggctgtggtggtgcatgcctgtggtcccagctacttgggaggcagaggcaggaggatcactcaagcccaggaggttgagggtgcagtgagccatgatctggccactgcactccagcctgggtgacagagcaagaccctgtatcaaaaaatagataataaaataaaaattgataaaaatagatcaatgaattgttagtctacgaatgatagtcatttttcacaattggcagtaaaaataggatttgtgtaaggtatgagtttaccatatttgttcattagatcttagtttcaagggaaagtatcatgtattttccagcatgataatgatgaatcatttaaagtacggctcataaaaatgaaaaaaaaaattggaagaaaaaaacaccttgggtacatagatgtgtaataaatacctgttgagttattggtaatctcttgctaggactgaatctcagtacttcagagcatgtaaaaatcaattttctgtgatcccacttaatcacaccgtgttttctttttttagatttcagctagcaattttgcaggggttggagaccaatagcgatgtcatgctttttggttgttgttattgtctgactcgtggattcagcatttcagaatatggtactctaatcttaaggctttgaaaagaaaccatggccattttttcttcatattttacctttattaattgggctgggtcctaactggttgccagagcccagaaatccaagttctgtcttttcagggaatatgcatagctaaagagttcattgtgtttgcaaaggtgtactaggagttctcatttcctcagatgctcatgtctgtaggctgttaagctctcatttcaatttttgcagtcttttaaaacaccacacttcttttccatcttgaagaccagttaaaactacctctggccaaaaatgttagtgttactagatattatcaaggtgtgagactaaaaagttagaaggctttaagatgtaaattatataagttaatgttttctttccctaaaagttctgacccttgctgacccctcaatcaaatgtttttaattgaaaggggaaagaaaatatcagagaacttaaagatggccttcgtgactttgactcaaaatcaatgcatttcattatgtatgggtcctacaccttgcttcctcaagtggccatgaaaaaaaatctcacgaccatgcaaactgatgccaccccaaagtcatggtaacgatttgaattgctctcagtattgatgtcaaactccctcctgttgtcagcagcttattgcaaactggccattctaaacccttttacccccaccttctctcaatcttagcagttaatctcagccctcccccaccacataacagcctcgggcagaacttcccacttagacacccacacacacacacgcttccttaccttcttgccagtgcctgtcctgcccaagacgaaccccttttcctgtgccctaggacctctcccttgataaatgacttgatctagctacagcctcacactcctggcacatacagctttgcatttaaacatgttcagatactccttccttcaaacaaaagacctttcctcaaccctttgaaagcctgagtaccactaaggtatactgcccttatctgcactctgtccattctgcagtctaccgaggcagtggtttttaaccctggctgcatgttagggtcacctgggaagttttaaaaagtcctaattcctggactggaccacagaccagttaaatcagcatggggaggtggggatgggtttcagtctttaaaaagaaatgtagctgaggctgagaaccaccactctaaaacctggctgctacccttgctaccattaaaactgttcttgctggattcacccaccagtgacttctactattaaaatttagcccataggttgatttttatgacactgatgctatataaccacttccttctttggaatgctccctttcctgaccctactttcctgatttttctgccacttctttgctctttctcagtttctgtggagttgtttggtaggtcagtctagcacagactggatgccggtctctgccgccacctccgttatttcagtgaacacctgtatgccagtgagttcctttgccataccaccttaatgcaccaacttaaaagcacagattagagtggagcattcacatttattactgcaggcttctaggaaagcatattaaaggtctctggtccttctctcacctcccttgttcctcctccaagcccagtgaggtaggaggaattgctaattagattagtgagattctaaggtgggtcactcctgtttacttatgagttgctatttatgaaaagatggcctggactgtgttccctcttctgctttctcctcttccgggtcttggactggtaagggggcctgtgcccaaaaggggctcctccacctaatgctgtctttaatctgtggctttctgctgctggttaattttttaatttggcttcctcaagcctttttggccttgaacttcatgttgatttttatcaaagaactttttattggggcatcagcactagccctatgaatacagtgaaacttggggttccactttcatcagatgtgaccctgtgtgttcctgatgtctttgaatcactagtttctgattcaaaatatggggtaggtggatctgattagtagtcatatgcctgtgtcctggctaggaagtcagaatgaggttatctggaaagttgagcttcctcacacatgggaaggtacttcagatgctggacagccaataagaataacaaaggtccaccagaaccattgccccagtcactgattgaacaaacatttactgaacactgatgaagcgaagtcctcctcagggacctcttagggaagagggtaactgccctaaagcaggatactcctgggctccttagatatactatccttgaaactattaggcccctgtccagagtacctaataataataatggcaaatatgtatttggtggtctgccatttggaagcaacatctcacttattcaacaactctaaaggtaggtacttttatctccattttaaaacaatgaaatacacttacagttacagacaaacttgctcgagtcacatatctattaagtgtcagtcaagattcagattcaagtctgatgttaaagagtgtctgttcccaatcaatacctctgctgcctctttttacaaactgaactgttggagggcatgtacatatgcataagctgtgggccactgggccatgggccagtgtctgatgagacctctttattgacttgtttgtcctggtgggctgtttctctaccaggcaactgtgaatgggctcatcccttctctgtgcgtacatgattgaaaggagatagccggtttctgtgacatcctcttataacaacctagttttgttcttgagagtgaccagagcaagagaaaagtcaatgaaattttgcagatcttgcaaacctgtggcaataagaaggtattatcctttctgtaccaaggcacaactgattcctaagtgagggggatatgtgttctgagatgttaatgttagtgatagactgttttcaacaccttggtaaacatttcttttgactgttagcaaaagctgccttaacagtcttggcttttagaaatgccccttcattcattagatgtgtatggaacacatcttatgccaagcactctgctaggagctgggtatacagagaagaaaggcattcctgctctcatgatgttcatggtcttctgcggaagagaccagaaaaaaagtattacaatgtagaatgaaataagaatgacagggtattttggcagcaaggaggagggcactttaactcaaactgggcagtggaagaagtaaaaaaaaacattgaaagaaatcctgaaggataagcaggagttaagaagagtggatgaagccctccaagggtaaaagcatggtttattcagagcactgcaagtgttttagtatggcccacatgtaaagcttacagaggaacaaagagagaaaggcaagagccaggaagtgaagggtcctgtgtatactggcttacttgttgagttggagaactattgccgtattcctctgctaagctcagggtgcattcgtggaaaccctactgcaactggcccattgtgcatacaaagctggaactgagatgtgaacagatttgcattgccttgatcaccttccgtgggaaatatagctaggcccacttattggtaggagctactgacatgttaaaactaggttaaactgaattggaagtaatggtgtatttggaatcatggctgactgattccattacatgttctagcatgataccagtctgaggttattccccttgaaccaccgacttagtagagtttaatgcacaatgtgatggtcttagttccttgtactgttcttcagtgtcaaagttgttcaactaccagttaagttttttgggctttgtttctcagtagtgacaataaatttgtgttgatctatttacaccttttggactgaacaccttagcaatcattgatattttaagcctacaggaagtgcccatgggataaaaccaatctgctggctcacactaagttctgatcccatgattttggtctcattaataccgtgctataaataaagttagctaaatcttttgaaactgcataaaagtgaaataattatgagttttgggccaacatttttcctgaacagcttctgactgaccagcattttaaattaggcgatgcagtctagcttttgtacatagaaataagaaagtgacttatgttccattattaaaatagtatagggaggacaggtaaattactaatttttcattgctcatagtagagaattaaggtatattgactagtgaaatagaggattatggggatcatatgaaaatatgattaaagagattatcactagaagaaaaattcagactgctaattatgagaaaaaacatgtatgcacaaccaaacaaatcacaaaaatgaaagatgtctaaaaccatagaataggaacaaatgtacctgtcatattaataaaagtaaacttatctgtagataaaaggcaaaaatgtcagcaaacactaatttcatgttataagattcagaaaggttgagcaaaagtaaaccaagcaaacacaaacaagaaaatgagttgtagtctgcatatcaggcaaggttgaacttagggaaaaggaaccggaaaaaaaaaaaccaaaaaaaaccacgacataatgctaaagggtgtgactcacgagataatgtttctagatatctgtgtaccaaataatggaaaaccatttatgtattggaaaccataggagacacaggaagaaacaaatacaatgttagttggatattttaattcaattctgtcaattcatgacagatcaagtggataaaaaactaggacatgggatgatttaaataagatacagaagatctagttgatgcatattagactttaccctaaaagtggtaactacacttcaaagtatccatgaaacatttccccatttgactgtgtattagagcgtacagaaaacataagtttcagaacggaaaaaaggaacaacagatggcatttgctgataaaaatgcaata

SEQ ID NO: 135790 - DNA, 2123 bp, Homo sapiens
  Payload ID: 6545
  Gene Symbol: GPATCH3
  Gene Name: G patch domain containing 3
  Uniprot ID: Q96I76
  ENST ID: ENST00000361720
  CDS Start-End: 25-1602
tagctgatcatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggctcctttcccttcaagacccggaaggaactgcagagttggaaggcagagaatgaagccttcaccctggctgacctgaagcaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactgg

SEQ ID NO: 135791 - DNA, 546 bp, Homo sapiens
  Payload ID: 6545
  Gene Symbol: GPATCH3
  Gene Name: G patch domain containing 3
  ENST ID: ENST00000445019
  CDS Start-End: 1-230
attttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactgga

SEQ ID NO: 135792 - DNA, 521 bp, Homo sapiens
  Payload ID: 6545
  Gene Symbol: GPATCH3
  Gene Name: G patch domain containing 3
  ENST ID: ENST00000450844
  CDS Start-End: 137-521
attaaaatgaataagtcaatcttacgagggggtcctagaaacctgattcttcccccttctttgagagggacgcttccataaactgagctctgtttcctcagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttg

SEQ ID NO: 135793 - DNA, 1972 bp, Homo sapiens
  Payload ID: 6546
  Gene Symbol: GPATCH4
  Gene Name: G patch domain containing 4
  ENST ID: ENST00000368232
  CDS Start-End: 134-1246
cggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtgatggaagaagcaggaaaagcaagaagaaaagacagcagcatcaagaggaggaggacatcttggatgtaagggatgagaaggatggcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggacgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaa

SEQ ID NO: 135794 - DNA, 1159 bp, Homo sapiens
  Payload ID: 6546
  Gene Symbol: GPATCH4
  Gene Name: G patch domain containing 4
  ENST ID: ENST00000438976
  CDS Start-End: 32-1159
aagatggcggcgcacaagtcaggtccggcacatgtttccgcggagcggacccagcaatgacgaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtga

SEQ ID NO: 135795 - DNA, 934 bp, Homo sapiens
  Payload ID: 6546
  Gene Symbol: GPATCH4
  Gene Name: G patch domain containing 4
  ENST ID: ENST00000415314
  CDS Start-End: 141-934
aacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaa

SEQ ID NO: 135796 - DNA, 857 bp, Homo sapiens
  Payload ID: 6546
  Gene Symbol: GPATCH4
  Gene Name: G patch domain containing 4
  ENST ID: ENST00000463513
  CDS Start-End: 113-472
ggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatc

SEQ ID NO: 135797 - DNA, 719 bp, Homo sapiens
  Payload ID: 6546
  Gene Symbol: GPATCH4
  Gene Name: G patch domain containing 4
  ENST ID: ENST00000474904
  CDS Start-End: 121-552
aagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagtgggatcctgtgaccagccttgctgttgcttacttagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaa

SEQ ID NO: 135798 - DNA, 457 bp, Homo sapiens
  Payload ID: 6547
  Gene Symbol: GPATCH8
  Gene Name: G patch domain containing 8
  ENST ID: ENST00000592746
  CDS Start-End: 34-174
gagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcgcagttggcccatattagctaagcagccatgatctggataatattggacaccgcttactccagaaacatgggtggaagctgggccagggattgggaaaatctcttcaggcattatgatcctggacttgttgtggtgatggtaatcttagcagtgggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagta

SEQ ID NO: 135799 - DNA, 686 bp, Homo sapiens
  Payload ID: 6547
  Gene Symbol: GPATCH8
  Gene Name: G patch domain containing 8
  ENST ID: ENST00000585614
  CDS Start-End: 22-686
gagaggagtgaaggcggcaaaatggcggaccgcttctcccgcttcaacgaagaccgagactttcaggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttg

SEQ ID NO: 135800 - DNA, 829 bp, Homo sapiens
  Payload ID: 6547
  Gene Symbol: GPATCH8
  Gene Name: G patch domain containing 8
  ENST ID: ENST00000590041
  CDS Start-End: 20-160
gaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcgcagttggcccatattagctaagcagccatgatctgtgaattgaaaacaagacaaaaaaaaaaacgaccattagtgattggacagtttcttactttgtgttacatttaactgttcttttgacagcccagtttttaaagccaggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgta

SEQ ID NO: 135801 - DNA, 4692 bp, Homo sapiens
  Payload ID: 6547
  Gene Symbol: GPATCH8
  Gene Name: G patch domain containing 8
  Uniprot ID: Q9UKJ3
  ENST ID: ENST00000591680
  CDS Start-End: 32-4540
gcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttag

SEQ ID NO: 135802 - DNA, 4713 bp, Homo sapiens
  Payload ID: 6547
  Gene Symbol: GPATCH8
  Gene Name: G patch domain containing 8
  Uniprot ID: Q9UKJ3
  ENST ID: ENST00000587228
  CDS Start-End: 35-166
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcgcccagtttttaaagccaggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttag

SEQ ID NO: 135803 - DNA, 345 bp, Homo sapiens
  Payload ID: 6547
  Gene Symbol: GPATCH8
  Gene Name: G patch domain containing 8
  ENST ID: ENST00000586037
  CDS Start-End: 34-174
gagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcgcagttggcccatattagctaagcagccatgatctggataatattggacaccgcttactccagaaacatgggtggaagctgggccagggattgggaaaatctcttcaggcattatgatcctggacttgttgtggtgatggtaatcttagcagtgggagaacagatcccattccaatcgttgtcaagtatgatg

SEQ ID NO: 135804 - DNA, 1842 bp, Homo sapiens
  Payload ID: 6548
  Gene Symbol: GPS1
  Gene Name: G protein pathway suppressor 1
  Uniprot ID: Q13098
  ENST ID: ENST00000306823
  CDS Start-End: 24-1499
cgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 135805 - DNA, 1949 bp, Homo sapiens
  Payload ID: 6548
  Gene Symbol: GPS1
  Gene Name: G protein pathway suppressor 1
  ENST ID: ENST00000320548
  CDS Start-End: 191-1606
agcgacggcttcgctgccccggaagtggacggcacgccgcggcggggtgggtgcaagatgccgctgccggttcaggtgtttaacttgcagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 135806 - DNA, 2276 bp, Homo sapiens
  Payload ID: 6548
  Gene Symbol: GPS1
  Gene Name: G protein pathway suppressor 1
  Uniprot ID: Q13098
  ENST ID: ENST00000392358
  CDS Start-End: 350-1933
cttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccggccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 135807 - DNA, 594 bp, Homo sapiens
  Payload ID: 6548
  Gene Symbol: GPS1
  Gene Name: G protein pathway suppressor 1
  ENST ID: ENST00000583885
  CDS Start-End: 36-594
aagtggacggcacgccgcggcggggtgggtgcaagatgccgctgccggttcaggtgtttaacttgcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccc

SEQ ID NO: 135808 - DNA, 795 bp, Homo sapiens
  Payload ID: 6548
  Gene Symbol: GPS1
  Gene Name: G protein pathway suppressor 1
  ENST ID: ENST00000583641
  CDS Start-End: 36-795
aagtggacggcacgccgcggcggggtgggtgcaagatgccgctgccggttcaggtgtttaacttgcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccggg

SEQ ID NO: 135809 - DNA, 594 bp, Homo sapiens
  Payload ID: 6548
  Gene Symbol: GPS1
  Gene Name: G protein pathway suppressor 1
  ENST ID: ENST00000580723
  CDS Start-End: 6-140
gcaagatgccgctgccggttcaggtgtttaacttgcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaag

SEQ ID NO: 135810 - DNA, 1874 bp, Homo sapiens
  Payload ID: 6548
  Gene Symbol: GPS1
  Gene Name: G protein pathway suppressor 1
  Uniprot ID: Q13098
  ENST ID: ENST00000578552
  CDS Start-End: 68-1531
gcgccccggaagcgacggcttcgctgccccggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 135811 - DNA, 1855 bp, Homo sapiens
  Payload ID: 6548
  Gene Symbol: GPS1
  Gene Name: G protein pathway suppressor 1
  ENST ID: ENST00000584460
  CDS Start-End: 4-138
aagatgccgctgccggttcaggtgtttaacttgcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagact

SEQ ID NO: 135812 - DNA, 997 bp, Homo sapiens
  Payload ID: 6548
  Gene Symbol: GPS1
  Gene Name: G protein pathway suppressor 1
  ENST ID: ENST00000585084
  CDS Start-End: 366-997
ccgggcctcgggagcctgggcagagaaaggcacccacagcagcgaaggggccgtggcttcggagcgagaaaggctcggggggcagatcccgcgggcgccggggagtgggggacactcaccgccctggagctcgagctcagggtcgtccccgtcggtgaagataaacgtctgggggagaaacaatctatgaggcttctggggcgctgcccaggccggagaccgacccgccccgcgcggagcctccgggggcctgggccgggcctagaccctgggaggcggggcgggtgggcgtggggctcgccgtcggggtcggggtccggcgcacctgctggcgggcccgggagatccagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagat

SEQ ID NO: 135813 - DNA, 552 bp, Homo sapiens
  Payload ID: 6548
  Gene Symbol: GPS1
  Gene Name: G protein pathway suppressor 1
  ENST ID: ENST00000578392
  CDS Start-End: 25-306
acgccgcggcggggtgggtgcaagatgccgctgccggttcaggtgtttaacttgcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctga

SEQ ID NO: 135814 - DNA, 580 bp, Homo sapiens
  Payload ID: 6548
  Gene Symbol: GPS1
  Gene Name: G protein pathway suppressor 1
  ENST ID: ENST00000581418
  CDS Start-End: 162-580
ggacggcacgccgcggcggggtgggtgcaagatgccgctgccggttcaggtgtttaacttgcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagag

SEQ ID NO: 135815 - DNA, 581 bp, Homo sapiens
  Payload ID: 6548
  Gene Symbol: GPS1
  Gene Name: G protein pathway suppressor 1
  ENST ID: ENST00000583961
  CDS Start-End: 77-581
ctgctggcgggcccgggagatccagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggagg

SEQ ID NO: 135816 - DNA, 574 bp, Homo sapiens
  Payload ID: 6548
  Gene Symbol: GPS1
  Gene Name: G protein pathway suppressor 1
  ENST ID: ENST00000583009
  CDS Start-End: 75-574
gctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctgga

SEQ ID NO: 135817 - DNA, 567 bp, Homo sapiens
  Payload ID: 6548
  Gene Symbol: GPS1
  Gene Name: G protein pathway suppressor 1
  ENST ID: ENST00000580716
  CDS Start-End: 64-567
gtcggggtcggggtccggcgcacctgctggcgggcccgggagatccagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgc

SEQ ID NO: 135818 - DNA, 543 bp, Homo sapiens
  Payload ID: 6548
  Gene Symbol: GPS1
  Gene Name: G protein pathway suppressor 1
  ENST ID: ENST00000580627
  CDS Start-End: 31-213
gacggcacgccgcggcggggtgggtgcaagatgccgctgccggttcaggtgtttaacttgcaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggcc

SEQ ID NO: 135819 - DNA, 583 bp, Homo sapiens
  Payload ID: 6548
  Gene Symbol: GPS1
  Gene Name: G protein pathway suppressor 1
  ENST ID: ENST00000578168
  CDS Start-End: 1-240
cagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 135820 - DNA, 924 bp, Homo sapiens
  Payload ID: 6548
  Gene Symbol: GPS1
  Gene Name: G protein pathway suppressor 1
  ENST ID: ENST00000580141
  CDS Start-End: 32-166
ggacggcacgccgcggcggggtgggtgcaagatgccgctgccggttcaggtgtttaacttgcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacg

SEQ ID NO: 135821 - DNA, 470 bp, Homo sapiens
  Payload ID: 6548
  Gene Symbol: GPS1
  Gene Name: G protein pathway suppressor 1
  ENST ID: ENST00000581578
  CDS Start-End: 166-470
aagtggacggcacgccgcggcggggtgggtgcaagatgccgctgccggttcaggtgtttaacttgcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctga

SEQ ID NO: 135822 - DNA, 561 bp, Homo sapiens
  Payload ID: 6548
  Gene Symbol: GPS1
  Gene Name: G protein pathway suppressor 1
  ENST ID: ENST00000582327
  CDS Start-End: 160-561
gaagcaggcggccatcggttgggatctcttgagtggaaacaggacggaggcagctcgccctgacctggcctggaagggcggattccctgctggcgcttcttcaggggacgtggcactagccccacgccccgggaagcggctagtggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggc

SEQ ID NO: 135823 - DNA, 1943 bp, Homo sapiens
  Payload ID: 6548
  Gene Symbol: GPS1
  Gene Name: G protein pathway suppressor 1
  ENST ID: ENST00000623761
  CDS Start-End: 66-1646
ctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtca

SEQ ID NO: 135824 - DNA, 1839 bp, Homo sapiens
  Payload ID: 6548
  Gene Symbol: GPS1
  Gene Name: G protein pathway suppressor 1
  ENST ID: ENST00000623691
  CDS Start-End: 36-1496
aagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 135825 - DNA, 1825 bp, Homo sapiens
  Payload ID: 6548
  Gene Symbol: GPS1
  Gene Name: G protein pathway suppressor 1
  ENST ID: ENST00000624957
  CDS Start-End: 40-1512
ccggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtggg

SEQ ID NO: 135826 - DNA, 1379 bp, Homo sapiens
  Payload ID: 6549
  Gene Symbol: GPS2
  Gene Name: G protein pathway suppressor 2
  Uniprot ID: Q13227
  ENST ID: ENST00000380728
  CDS Start-End: 302-1285
gggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccact

SEQ ID NO: 135827 - DNA, 1371 bp, Homo sapiens
  Payload ID: 6549
  Gene Symbol: GPS2
  Gene Name: G protein pathway suppressor 2
  Uniprot ID: Q13227
  ENST ID: ENST00000389167
  CDS Start-End: 292-1275
gcagagaaggcgggtaggaagggcagtcgtccgcgctggctgggcagggagcggcagcagcgagccggggaccccggcgccgcccgcgcgcggtgggactggggctgcggtcccggccgggtggcgggctcctgggacacgtgaccggggcggcgagcgggccgggcggacgggcttccgcctgggccgggcgcggccccctctgagcgcccgcctccccgcaggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgc

SEQ ID NO: 135828 - DNA, 573 bp, Homo sapiens
  Payload ID: 6549
  Gene Symbol: GPS2
  Gene Name: G protein pathway suppressor 2
  ENST ID: ENST00000573684
  CDS Start-End: 1-477
acccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcagctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgc

SEQ ID NO: 135829 - DNA, 523 bp, Homo sapiens
  Payload ID: 6549
  Gene Symbol: GPS2
  Gene Name: G protein pathway suppressor 2
  ENST ID: ENST00000574458
  CDS Start-End: 1-221
ccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaaggtaagaatggtaatagaatttacctgtcagaatccctacactagggatccggaaaagcaggattaggtaggacaggtggcccacatcatctggtttttccttcctctttgggggtggttatcagtagggtattaagtggaagggagagtatgcccagtgacaaagccctcttttcatcaccaccaccagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactg

SEQ ID NO: 135830 - DNA, 1238 bp, Homo sapiens
  Payload ID: 6549
  Gene Symbol: GPS2
  Gene Name: G protein pathway suppressor 2
  ENST ID: ENST00000570780
  CDS Start-End: 1-983
gcaggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagacagcaccgtgatctggagaagcaagagggatagccaagagatgtctgagctcaggaagaaacgtacagaacaaagctgagcacagaagcagggagggaggcaccataccaggatctcttctccacagtcgtacttctgctcaatctccttgccaaggtctccctcagggagacgaaggtcctctcgtacctccccgctgtcctggagcagtgataggtacccatcctggatgccaatcagctgggggcagatagggaaggaggctg

SEQ ID NO: 135831 - DNA, 916 bp, Homo sapiens
  Payload ID: 6549
  Gene Symbol: GPS2
  Gene Name: G protein pathway suppressor 2
  ENST ID: ENST00000577040
  CDS Start-End: 139-916
ggcagtcgtccgcgctggctgggcagggagcggcagcagcgagccggggaccccggcgccgcccgcgcgcggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgcta

SEQ ID NO: 135832 - DNA, 4211 bp, Homo sapiens
  Payload ID: 6550
  Gene Symbol: GPRIN1
  Gene Name: G protein regulated inducer of neurite outgrowth 1
  Uniprot ID: Q7Z2K8
  ENST ID: ENST00000303991
  CDS Start-End: 179-3205
gggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaggaaggaggatcctgggtctttgagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccatgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggggaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgcgtggagccgaaggccgagcccgtgtccagcaccgaggcctccagtctcggccagaaagacctggaagccgctggggccgagagaagcccctgcccagaggccgcagcgcccccgccggggccgcggactcgcgacaacttcaccaaggcgccgtcgtgggaggcgagcgccccgccgccgccgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgccgcgccgcccgccttccccgaagtgcgggtgcggcccggctcagcgctggcggccgctgtagcgcccccggagccggctgagcccgtgcgagacgtgagctgggacgagaagggcatgacgtgggaggtatacggcgccgccatggaggtggaggtgctgggcatggccatccagaagcatctggagcgacagatcgaggagcacggccgccaaggggcgcccgcgccgccgcccgccgcccgtgccggccccggccgttcgggctcggtgcgcaccgcgcccccagatggcgccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttccccaa

SEQ ID NO: 135833 - DNA, 1696 bp, Homo sapiens
  Payload ID: 6551
  Gene Symbol: GPRIN2
  Gene Name: G protein regulated inducer of neurite outgrowth 2
  Uniprot ID: O60269
  ENST ID: ENST00000374314
  CDS Start-End: 9-1385
aggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttca

SEQ ID NO: 135834 - DNA, 1966 bp, Homo sapiens
  Payload ID: 6551
  Gene Symbol: GPRIN2
  Gene Name: G protein regulated inducer of neurite outgrowth 2
  Uniprot ID: O60269
  ENST ID: ENST00000374317
  CDS Start-End: 274-1650
ggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagagttgctgacaggtggaacctgaggcagcaggacagcctggcattggccacgggacatcggccacaaccatagcaacttcggcatcaaatggggcaggagagagaacattaaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactcca

SEQ ID NO: 135835 - DNA, 1465 bp, Homo sapiens
  Payload ID: 6552
  Gene Symbol: GPBAR1
  Gene Name: G protein-coupled bile acid receptor 1
  Uniprot ID: Q8TDU6
  ENST ID: ENST00000521462
  CDS Start-End: 342-1334
gcctgggtaggagagcctggccccgctgtccccactgggtggagacaccatgcacttggtccacttgtgctcttcagccaggacaccagacatggtccaaaccgctgcagggctggctgcagcaactccctgacactcaggaaggcccaggctgggcaggcaatacctgctcccaacagccatcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctc

SEQ ID NO: 135836 - DNA, 1382 bp, Homo sapiens
  Payload ID: 6552
  Gene Symbol: GPBAR1
  Gene Name: G protein-coupled bile acid receptor 1
  Uniprot ID: Q8TDU6
  ENST ID: ENST00000519574
  CDS Start-End: 248-1240
gagaacccagacgggcagagcctgggtaggagagcctggccccgctgtccccactgggtggagacaccatgcacttggtccacttgtgctcttcagccaggacaccagacatggtccaaaccgctgcagggctggctgcagcaactccctgacactcaggaaggcccaggctgggcaggcaatacctgctcccaacagccatgcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtt

SEQ ID NO: 135837 - DNA, 1869 bp, Homo sapiens
  Payload ID: 6552
  Gene Symbol: GPBAR1
  Gene Name: G protein-coupled bile acid receptor 1
  Uniprot ID: Q8TDU6
  ENST ID: ENST00000479077
  CDS Start-End: 735-1727
cccgaccagatcccgtggttctgaggaccggccctggaaccctgcgtccttccgacccaccagctccctcgaggatggacttgaggctggatgctttcctcttcccactttttgtcccaacagaagtccctgatctccaggatccctgactggctgtgcagagctggcacagccacactccacgggcttccagcccttcaggcccagctctcccggagagcaccagagtccctttgctccatttacttgcgctcttcagccagcaagtgtttcctaatgtctcacccccagtcccagctttcctgctgcaatttccgcctgttccctcccatttcaggccttaagggagtgtggctgggcttctctcctccccctcactccaaagccgcacttgatacaaggtggaaatcaaagcaccacttctggcttcccagccttgaacttgcccttccctctcaatgtatctggtttcctcagcttccctgtgcagcaagagtgtcactcccctcttgcttttcccaagctccccatgcgcccctctcagcagatctgtcttagaggggccaggtgcagagaaaggcagaaatcctaataatgttcccagcgatcgctgcctgtcgcggagtgctgaagggccaagtgttgatctgagtcctcatcacacgggacttcatttagtctcacgataggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtt

SEQ ID NO: 135838 - DNA, 2003 bp, Homo sapiens
  Payload ID: 6552
  Gene Symbol: GPBAR1
  Gene Name: G protein-coupled bile acid receptor 1
  Uniprot ID: Q8TDU6
  ENST ID: ENST00000522678
  CDS Start-End: 869-1861
gagaacccagacgggcagagcctgggtaggagagcctggccccgctgtccccactgggtggagacaccatgcacttggtccacttgtgctcttcagccaggacaccagacatggtccaaaccgctgcagggctggctgcagcaactccctgacactcaggaaggcccaggctgggcaggcaatacctgctcccaacagccatctcccaggaaggaccctgttgctagtgtggagcaaagacgagtcaagtttatgggctggaagtcctacccggaggctgctcactgagctgtgatggctacaaggacagatggggggaagggtgcagggtgcccgagacctggcccgctggagcctgtcacctaatggctggctggaagaccactacacaccagccagccctggtccattctctcatttagaggcctccccggtggaggcagggatacacaaaatgctttggggctggatgggcccgcctttcagtctaaacaagagacctcaacacagctgcccagaaaaggcagataccagaaatggataaagctggctgggtggggactgtccgaagggcagccagcagtgagctccggctggttgctaccacacaggacatatgtgttgccagacctgaattttcaatagaaaccaaagatagttttttatataaatgtttaattggcaattaattgaaaaattctgtgtatcagcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtt

SEQ ID NO: 135839 - DNA, 2778 bp, Homo sapiens
  Payload ID: 6553
  Gene Symbol: GPER1
  Gene Name: G protein-coupled estrogen receptor 1
  Uniprot ID: Q99527
  ENST ID: ENST00000297469
  CDS Start-End: 692-1819
ggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 135840 - DNA, 2639 bp, Homo sapiens
  Payload ID: 6553
  Gene Symbol: GPER1
  Gene Name: G protein-coupled estrogen receptor 1
  Uniprot ID: Q99527
  ENST ID: ENST00000397088
  CDS Start-End: 558-1685
aaagccctgtgccaaggggcagactcactggctcagagggaggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcgga

SEQ ID NO: 135841 - DNA, 2971 bp, Homo sapiens
  Payload ID: 6553
  Gene Symbol: GPER1
  Gene Name: G protein-coupled estrogen receptor 1
  Uniprot ID: Q99527
  ENST ID: ENST00000397092
  CDS Start-End: 885-2012
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 135842 - DNA, 1542 bp, Homo sapiens
  Payload ID: 6553
  Gene Symbol: GPER1
  Gene Name: G protein-coupled estrogen receptor 1
  Uniprot ID: Q99527
  ENST ID: ENST00000401670
  CDS Start-End: 390-1517
attccatggtactcggagtcctgggaaccactcatcactgtcgggtgcaggtggacgtcccctcacggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagc

SEQ ID NO: 135843 - DNA, 1105 bp, Homo sapiens
  Payload ID: 6553
  Gene Symbol: GPER1
  Gene Name: G protein-coupled estrogen receptor 1
  ENST ID: ENST00000413368
  CDS Start-End: 885-1105
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctt

SEQ ID NO: 135844 - DNA, 1900 bp, Homo sapiens
  Payload ID: 6553
  Gene Symbol: GPER1
  Gene Name: G protein-coupled estrogen receptor 1
  ENST ID: ENST00000617001
  CDS Start-End: 102-1328
cttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcgg

SEQ ID NO: 135845 - DNA, 571 bp, Homo sapiens
  Payload ID: 6553
  Gene Symbol: GPER1
  Gene Name: G protein-coupled estrogen receptor 1
  ENST ID: ENST00000619052
  CDS Start-End: 1-531
atgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttccc

SEQ ID NO: 135846 - DNA, 2295 bp, Homo sapiens
  Payload ID: 6554
  Gene Symbol: GPR1
  Gene Name: G protein-coupled receptor 1
  Uniprot ID: P46091
  ENST ID: ENST00000407325
  CDS Start-End: 364-1431
aaaccacatttccttttccagggcaataacttaaaatattatgtatttccctttgttgcaaagagaggaaatacttcttcctagactcagggcagctgtgacccgtcctcccagagaaatcattaaaccacaaggattcagacagagcccagagccctgaaaactttggccacgcactttcccgcagcagccacaggcaccggcaacttcagagagccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaagcatcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataagttattacttttccacaaatcagtatatggctttttatgtgggtcctctgactgatgctttcagattaaaattgtttccaagatagagagccgactccactttcatagttattgtttctggtcactatataggcatcacatttttgtgtggatatgaaacttaggaaggatcctcttgactccttgtgatgtggcaataaattttttttaaaaaactgaaaatacttaggaaggatccgcataatttttttctgcaacttaaatgaaatgcatcattcttgttaattataccatggtgaattaatcacttttgaagcaatatcagttattttttgaataataacttttctaaagccttaagtcttaatattaaatatatgattagccaggcacggtggctgacacctgtaatcccagcactttgggaggccaaggtggggggattacccgaggtcaggaattcgagaccagcctgaccaacatggagaaaccccgtctctactaaaaatacaaaattagccggtcatggtggtgcatgtctgcaaacccagctactcgggaggctgaagcaggagaatcacttgaacctgggaggcagaggttgtggtgagccaacatcacaccattgcactccagcctgggcaacaagagtaaaactctgtctcaaaaataaataaataaaatagataaataaatatatgattaactaattttaaaaatgttaaaatgtattcttaaattcattttaattttgtacaataacctgctagacacatttttaaaatgcaacatgtgtacttaatttctttatgtaatctatgtatatacatttatgaattaaagtaattgttggttatcttaaaa

SEQ ID NO: 135847 - DNA, 756 bp, Homo sapiens
  Payload ID: 6554
  Gene Symbol: GPR1
  Gene Name: G protein-coupled receptor 1
  ENST ID: ENST00000451790
  CDS Start-End: 222-756
agctagtagcagtggtttccattcaaaaaacaaacttcttacacaaacataggctggtcgaaagaattaatttgtacaataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactg

SEQ ID NO: 135848 - DNA, 1557 bp, Homo sapiens
  Payload ID: 6554
  Gene Symbol: GPR1
  Gene Name: G protein-coupled receptor 1
  Uniprot ID: P46091
  ENST ID: ENST00000437420
  CDS Start-End: 490-1557
attaaaccacaaggattcagacagagcccagagccctgaaaactttggccacgcactttcccgcagcagccacaggcaccggcaacttcagagaggtaattagaacttcggaaatcttagtggaaaagatggagaactaagtcctccgcagactttcccactaagtatcctcaagaatcactttctgcatcgggcaaaacagaattagaagcaagaatctagacaaggcttcgtcctcatttagaagcctttaagaattctctgctttaagtggatgaaaacgtccctgtatggctgggttgccatggttcctcgctgtgacccccagggctactgagcctgccatataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaagcatcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataa

SEQ ID NO: 135849 - DNA, 603 bp, Homo sapiens
  Payload ID: 6554
  Gene Symbol: GPR1
  Gene Name: G protein-coupled receptor 1
  ENST ID: ENST00000411719
  CDS Start-End: 383-603
aacagatttacttaaccactggcaaaccacatttccttttccagggcaataacttaaaatattatgtatttccctttgttgcaaagagaggaaatacttcttcctagactcagggcagctgtgacccgtcctcccagagaaatcattaaaccacaaggattcagacagagcccagagccctgaaaactttggccacgcactttcccgcagcagccacaggcaccggcaacttcagagagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactct

SEQ ID NO: 135850 - DNA, 592 bp, Homo sapiens
  Payload ID: 6554
  Gene Symbol: GPR1
  Gene Name: G protein-coupled receptor 1
  ENST ID: ENST00000439932
  CDS Start-End: 345-592
attcgaagaacattccatctctgctaatttaacttgccttttcataagcaaaagcctacccagacaaaggagggctgggtgacccccatccattaccgattttcagtctgcagcagaacagctagtagcagtggtttccattcaaaaaacaaacttcttacacaaacataggctggtcgaaagaattaatttgtacaccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcgga

SEQ ID NO: 135851 - DNA, 572 bp, Homo sapiens
  Payload ID: 6554
  Gene Symbol: GPR1
  Gene Name: G protein-coupled receptor 1
  ENST ID: ENST00000447845
  CDS Start-End: 161-572
gtcatttcaaaagccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatcc

SEQ ID NO: 135852 - DNA, 830 bp, Homo sapiens
  Payload ID: 6554
  Gene Symbol: GPR1
  Gene Name: G protein-coupled receptor 1
  ENST ID: ENST00000442134
  CDS Start-End: 149-830
attctggaaccgggaaggtacacccaggcatgacaatagcttctctcctcacagaaatttaactgttccctatatcatcgatgaaggaacaggagctgattgtaccaaaacacttatatgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgt

SEQ ID NO: 135853 - DNA, 547 bp, Homo sapiens
  Payload ID: 6554
  Gene Symbol: GPR1
  Gene Name: G protein-coupled receptor 1
  ENST ID: ENST00000458440
  CDS Start-End: 491-547
aaaccacaaggattcagacagagcccagagccctgaaaactttggccacgcactttcccgcagcagccacaggcaccggcaacttcagagaggtaattagaacttcggaaatcttagtggaaaagatggagaactaagtcctccgcagactttcccactaagtatcctcaagaatcactttctgcatcgggcaaaacagaattagaagcaagaatctagacaaggcttcgtcctcatttagaagcctttaagaattctctgctttaagtggatgaaaacgtccctgtatggctgggttgccatggttcctcgctgtgacccccagggctactgagcctgccatccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgaccta

SEQ ID NO: 135854 - DNA, 2565 bp, Homo sapiens
  Payload ID: 6554
  Gene Symbol: GPR1
  Gene Name: G protein-coupled receptor 1
  Uniprot ID: P46091
  ENST ID: ENST00000612892
  CDS Start-End: 638-1705
aacagatttacttaaccactggcaaaccacatttccttttccagggcaataacttaaaatattatgtatttccctttgttgcaaagagaggaaatacttcttcctagactcagggcagctgtgacccgtcctcccagagaaatcattaaaccacaaggattcagacagagcccagagccctgaaaactttggccacgcactttcccgcagcagccacaggcaccggcaacttcagagaggtaattagaacttcggaaatcttagtggaaaagatggagaactaagtcctccgcagactttcccactaagtatcctcaagaatcactttctgcatcgggcaaaacagaattagaagcaagaatctagacaaggcttcgtcctcatttagaagcctttaagaattctctgctttaagtggatgaaaacgtccctgtatggctgggttgccatggttcctcgctgtgacccccagggctactgagcctgccatccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaagcatcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataagttattacttttccacaaatcagtatatggctttttatgtgggtcctctgactgatgctttcagattaaaattgtttccaagatagagagccgactccactttcatagttattgtttctggtcactatataggcatcacatttttgtgtggatatgaaacttaggaaggatcctcttgactccttgtgatgtggcaataaattttttttaaaaaactgaaaatacttaggaaggatccgcataatttttttctgcaacttaaatgaaatgcatcattcttgttaattataccatggtgaattaatcacttttgaagcaatatcagttattttttgaataataacttttctaaagccttaagtcttaatattaaatatatgattagccaggcacggtggctgacacctgtaatcccagcactttgggaggccaaggtggggggattacccgaggtcaggaattcgagaccagcctgaccaacatggagaaaccccgtctctactaaaaatacaaaattagccggtcatggtggtgcatgtctgcaaacccagctactcgggaggctgaagcaggagaatcacttgaacctgggaggcagaggttgtggtgagccaacatcacaccattgcactccagcctgggcaacaagagtaaaactctgtctcaaaaataaataaataaaatagataaataaatatatgattaactaattttaaaaatgttaaaatgtattcttaaattcattttaattttgtacaataacctgctagacacatttttaaaatgcaacatgtgtacttaatttctttatgtaatctatgtatatacatttatgaattaaagtaattgttggttatctt

SEQ ID NO: 135855 - DNA, 2156 bp, Homo sapiens
  Payload ID: 6554
  Gene Symbol: GPR1
  Gene Name: G protein-coupled receptor 1
  Uniprot ID: P46091
  ENST ID: ENST00000621141
  CDS Start-End: 229-1296
aacagctagtagcagtggtttccattcaaaaaacaaacttcttacacaaacataggctggtcgaaagaattaatttgtacaccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaagcatcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataagttattacttttccacaaatcagtatatggctttttatgtgggtcctctgactgatgctttcagattaaaattgtttccaagatagagagccgactccactttcatagttattgtttctggtcactatataggcatcacatttttgtgtggatatgaaacttaggaaggatcctcttgactccttgtgatgtggcaataaattttttttaaaaaactgaaaatacttaggaaggatccgcataatttttttctgcaacttaaatgaaatgcatcattcttgttaattataccatggtgaattaatcacttttgaagcaatatcagttattttttgaataataacttttctaaagccttaagtcttaatattaaatatatgattagccaggcacggtggctgacacctgtaatcccagcactttgggaggccaaggtggggggattacccgaggtcaggaattcgagaccagcctgaccaacatggagaaaccccgtctctactaaaaatacaaaattagccggtcatggtggtgcatgtctgcaaacccagctactcgggaggctgaagcaggagaatcacttgaacctgggaggcagaggttgtggtgagccaacatcacaccattgcactccagcctgggcaacaagagtaaaactctgtctcaaaaataaataaataaaatagataaataaatatatgattaactaattttaaaaatgttaaaatgtattcttaaattcattttaattttgtacaataacctgctagacacatttttaaaatgcaacatgtgtacttaatttctttatgtaatctatgtatatacatttatgaattaaagtaattgttggttatctt

SEQ ID NO: 135856 - DNA, 1527 bp, Homo sapiens
  Payload ID: 6555
  Gene Symbol: GPR101
  Gene Name: G protein-coupled receptor 101
  Uniprot ID: Q96P66
  ENST ID: ENST00000298110
  CDS Start-End: 1-1527
atgacgtccacctgcaccaacagcacgcgcgagagtaacagcagccacacgtgcatgcccctctccaaaatgcccatcagcctggcccacggcatcatccgctcaaccgtgctggttatcttcctcgccgcctctttcgtcggcaacatagtgctggcgctagtgttgcagcgcaagccgcagctgctgcaggtgaccaaccgttttatctttaacctcctcgtcaccgacctgctgcagatttcgctcgtggccccctgggtggtggccacctctgtgcctctcttctggcccctcaacagccacttctgcacggccctggttagcctcacccacctgttcgccttcgccagcgtcaacaccattgtcgtggtgtcagtggatcgctacttgtccatcatccaccctctctcctacccgtccaagatgacccagcgccgcggttacctgctcctctatggcacctggattgtggccatcctgcagagcactcctccactctacggctggggccaggctgcctttgatgagcgcaatgctctctgctccatgatctggggggccagccccagctacactattctcagcgtggtgtccttcatcgtcattccactgattgtcatgattgcctgctactccgtggtgttctgtgcagcccggaggcagcatgctctgctgtacaatgtcaagagacacagcttggaagtgcgagtcaaggactgtgtggagaatgaggatgaagagggagcagagaagaaggaggagttccaggatgagagtgagtttcgccgccagcatgaaggtgaggtcaaggccaaggagggcagaatggaagccaaggacggcagcctgaaggccaaggaaggaagcacggggaccagtgagagtagtgtagaggccaggggcagcgaggaggtcagagagagcagcacggtggccagcgacggcagcatggagggtaaggaaggcagcaccaaagttgaggagaacagcatgaaggcagacaagggtcgcacagaggtcaaccagtgcagcattgacttgggtgaagatgacatggagtttggtgaagacgacatcaatttcagtgaggatgacgtcgaggcagtgaacatcccggagagcctcccacccagtcgtcgtaacagcaacagcaaccctcctctgcccaggtgctaccagtgcaaagctgctaaagtgatcttcatcatcattttctcctatgtgctatccctggggccctactgctttttagcagtcctggccgtgtgggtggatgtcgaaacccaggtaccccagtgggtgatcaccataatcatctggcttttcttcctgcagtgctgcatccacccctatgtctatggctacatgcacaagaccattaagaaggaaatccaggacatgctgaagaagttcttctgcaaggaaaagcccccgaaagaagatagccacccagacctgcccggaacagagggtgggactgaaggcaagattgtcccttcctacgattctgctacttttccttga

SEQ ID NO: 135857 - DNA, 7209 bp, Homo sapiens
  Payload ID: 6556
  Gene Symbol: GPR107
  Gene Name: G protein-coupled receptor 107
  Uniprot ID: Q5VW38
  ENST ID: ENST00000347136
  CDS Start-End: 508-2166
attattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaa

SEQ ID NO: 135858 - DNA, 7353 bp, Homo sapiens
  Payload ID: 6556
  Gene Symbol: GPR107
  Gene Name: G protein-coupled receptor 107
  Uniprot ID: Q5VW38
  ENST ID: ENST00000372406
  CDS Start-End: 508-2310
attattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagagtctcaccattttgcccaggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaa

SEQ ID NO: 135859 - DNA, 6991 bp, Homo sapiens
  Payload ID: 6556
  Gene Symbol: GPR107
  Gene Name: G protein-coupled receptor 107
  ENST ID: ENST00000372410
  CDS Start-End: 228-1943
tggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaaccgtg

SEQ ID NO: 135860 - DNA, 2833 bp, Homo sapiens
  Payload ID: 6556
  Gene Symbol: GPR107
  Gene Name: G protein-coupled receptor 107
  ENST ID: ENST00000493417
  CDS Start-End: 13-399
gctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgtgtaagaaatctttcttccctcttccttagccctgacccctttgcctaacacaaagcagcacagtgtgaatcgggtcggctgctctcagcatttcgtggctgcaggggtggttcctctatttttagcagaaggaagcggacactggagccccaggctgtctgatctggtttgaagtacagtatctgccaaacctagctgggtcttgtcagggaagatggaacttgccgttccactaagcatcattggagcctgctttcaagaactcagtggcaagaacttaggaatatacgtggccagttcacgagggagaacagggggccgactttctgtcaggcccgccatcaggcgcttacgtctgaaaatggaatcttctgagtcatctctaagtctgctaatgatcctcagacatcctctatcgtcagataactgcgtggcttttcacagcacaatgactttgacctatatctgagcactaataggggcttttctgagtcacacagtgaatgactctagggtcctattttctgggaaagggccatcattgtctagaaaaatgagtagtgattaagcatatttgcttgttaactgaaatttgataagccaggtcaatgctgtgtttgatgattagcctaaggcagagttttcccttcttggttcactggtatcaagtgttctgcccccagccctggcagcctttgaattcttcccaattcagaggctgagactcggcccatgctaagctctgcttggctgtcagcgggtcaggcagcatgggacagctctctctgctcagctccacggcaacagtaaaggaaggcaggtcctgccagcgggcgccaaacagcatctccccatgcagaggaagaaacacctccttctaaacagtggagaggagtgcaggaggcccatcagctgtgcctttcccagaagtggcaggatctgagcaagtgtctgttggttgaagaggcacacatgtcaggctggcaaccagcagcatcaggaaataacctaagacgcggtgtgtttatcattcccctgctgggagcctttggcttggtccgtccgcataacacggggttctttgggtaggcagctagaagccgagcggccgggtcgcagcatcgtctcctttactgcattgtactccacagtcgtaatgggaggttcccgcttcccacatcctttccctcagccgttacatcttggagcctggatgcattatgaaggtatttttgtttcgtggcaacaatttttttaaaattt

SEQ ID NO: 135861 - DNA, 2813 bp, Homo sapiens
  Payload ID: 6556
  Gene Symbol: GPR107
  Gene Name: G protein-coupled receptor 107
  Uniprot ID: Q5VW38
  ENST ID: ENST00000610997
  CDS Start-End: 9-1811
gaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagagtctcaccattttgcccaggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtagg

SEQ ID NO: 135862 - DNA, 2057 bp, Homo sapiens
  Payload ID: 6557
  Gene Symbol: GPR108
  Gene Name: G protein-coupled receptor 108
  Uniprot ID: Q9NPR9
  ENST ID: ENST00000264080
  CDS Start-End: 28-1659
ggagtcggggaggaggtggctccagagatggcagtgagcgagaggagggggctcggccgcgggagccccgcggagtgggggcagcggctacttctggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaa

SEQ ID NO: 135863 - DNA, 2009 bp, Homo sapiens
  Payload ID: 6557
  Gene Symbol: GPR108
  Gene Name: G protein-coupled receptor 108
  ENST ID: ENST00000430424
  CDS Start-End: 878-1783
tcgctggggtcggccccctcccttcgggggcgaggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatattgctgggagctcaactggaatgtaaaagttcttcgggaaggtgaaggtcaggcacgccgagggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagcta

SEQ ID NO: 135864 - DNA, 670 bp, Homo sapiens
  Payload ID: 6557
  Gene Symbol: GPR108
  Gene Name: G protein-coupled receptor 108
  ENST ID: ENST00000601716
  CDS Start-End: 1-670
ggcagtgagcgagaggagggggctcggccgcgggagccccgcggagtgggggcagcggctacttctggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctgacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacg

SEQ ID NO: 135865 - DNA, 765 bp, Homo sapiens
  Payload ID: 6557
  Gene Symbol: GPR108
  Gene Name: G protein-coupled receptor 108
  ENST ID: ENST00000597298
  CDS Start-End: 657-765
gagtggtctcgtcccgggatccccttcggtcctccggatggagttgccggggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctggg

SEQ ID NO: 135866 - DNA, 778 bp, Homo sapiens
  Payload ID: 6557
  Gene Symbol: GPR108
  Gene Name: G protein-coupled receptor 108
  ENST ID: ENST00000594034
  CDS Start-End: 1-534
tcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgacca

SEQ ID NO: 135867 - DNA, 1750 bp, Homo sapiens
  Payload ID: 6557
  Gene Symbol: GPR108
  Gene Name: G protein-coupled receptor 108
  ENST ID: ENST00000595908
  CDS Start-End: 1-311
tggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcagtgagttggggaccgggggctcgctcagatccttcgtctgcgtttccctggtgtgatgcccacacgcacctgggctgatcagggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctat

SEQ ID NO: 135868 - DNA, 1834 bp, Homo sapiens
  Payload ID: 6557
  Gene Symbol: GPR108
  Gene Name: G protein-coupled receptor 108
  ENST ID: ENST00000597706
  CDS Start-End: 1-995
ggagggggctcggccgcgggagccccgcggagtgggggcagcggctacttctggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgtgagctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccct

SEQ ID NO: 135869 - DNA, 671 bp, Homo sapiens
  Payload ID: 6557
  Gene Symbol: GPR108
  Gene Name: G protein-coupled receptor 108
  ENST ID: ENST00000598052
  CDS Start-End: 1-437
gccccgcggagtgggggcagcggctacttctggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctcta

SEQ ID NO: 135870 - DNA, 523 bp, Homo sapiens
  Payload ID: 6557
  Gene Symbol: GPR108
  Gene Name: G protein-coupled receptor 108
  ENST ID: ENST00000594500
  CDS Start-End: 1-504
tgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcta

SEQ ID NO: 135871 - DNA, 581 bp, Homo sapiens
  Payload ID: 6557
  Gene Symbol: GPR108
  Gene Name: G protein-coupled receptor 108
  ENST ID: ENST00000598955
  CDS Start-End: 1-581
gtgatgatccgggagaagaaccccgatggcttcctgtcggcagcggagatgccccttttcaagctctacatggtcatgtccgcctgcttcctggccgctggcatcttctgggtgtccatcctctgcaggaacacatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatc

SEQ ID NO: 135872 - DNA, 1008 bp, Homo sapiens
  Payload ID: 6558
  Gene Symbol: GPR119
  Gene Name: G protein-coupled receptor 119
  Uniprot ID: Q8TDV5
  ENST ID: ENST00000276218
  CDS Start-End: 1-1008
atggaatcatctttctcatttggagtgatccttgctgtcctggcctccctcatcattgctactaacacactagtggctgtggctgtgctgctgttgatccacaagaatgatggtgtcagtctctgcttcaccttgaatctggctgtggctgacaccttgattggtgtggccatctctggcctactcacagaccagctctccagcccttctcggcccacacagaagaccctgtgcagcctgcggatggcatttgtcacttcctccgcagctgcctctgtcctcacggtcatgctgatcacctttgacaggtaccttgccatcaagcagcccttccgctacttgaagatcatgagtgggttcgtggccggggcctgcattgccgggctgtggttagtgtcttacctcattggcttcctcccactcggaatccccatgttccagcagactgcctacaaagggcagtgcagcttctttgctgtatttcaccctcacttcgtgctgaccctctcctgcgttggcttcttcccagccatgctcctctttgtcttcttctactgcgacatgctcaagattgcctccatgcacagccagcagattcgaaagatggaacatgcaggagccatggctggaggttatcgatccccacggactcccagcgacttcaaagctctccgtactgtgtctgttctcattgggagctttgctctatcctggacccccttccttatcactggcattgtgcaggtggcctgccaggagtgtcacctctacctagtgctggaacggtacctgtggctgctcggcgtgggcaactccctgctcaacccactcatctatgcctattggcagaaggaggtgcgactgcagctctaccacatggccctaggagtgaagaaggtgctcacctcattcctcctctttctctcggccaggaattgtggcccagagaggcccagggaaagttcctgtcacatcgtcactatctccagctcagagtttgatggctaa

SEQ ID NO: 135873 - DNA, 1981 bp, Homo sapiens
  Payload ID: 6559
  Gene Symbol: GPR12
  Gene Name: G protein-coupled receptor 12
  Uniprot ID: P47775
  ENST ID: ENST00000381436
  CDS Start-End: 464-1468
ggaaataggcgatttaaatattccatcgaggatggcggcccctggctcgagacctgccgctgccgcgtggttttctcggcagcagcccagatgtcaaacagttgttcgttttcagcatgcaagatgtgattttccaatgtgcattcccagcgctgttgcaaacagaccgccgcgagtccgtgtgtgcctgcctcgctcacgctggtgttttgaagtcctaccctgtgttttccccaatgccaaacggcatttttgttgtggggtttaaaccacagagactttggcttttgtttcatttcccaacagttcctcattcccgaagcttgtggcatttggtactggtatctgagcaggggctggctttctgtttgtctgtgtgttttttgcatgatcttggattgtcaccctgctgtatttaaacattaaaaagcctgtcttttcgttgaagaggacaggggttaaaatgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattccttgcattggattccctctcaagccacaggagcacttagcattcgtgaaacaatgacatcgttcagatgagttaagtgattgaagtgaaaataatgttaccagtgttttcaccattaaaaaaaattgttgagctctccactcaacattattttgttttgcttgggggcaagggtttccttttatactttgtttggagggctgactgggggtaggaaaggaagggatatgatacgcccatgatgttattagaagtaaatgagtttcagagtttttacctggactttaaaataaatttgagtgattgaggaaaattgagaaagacttactttttccagactattttttttttttacatgatggtagattttttaatgctgcatgtatgtaacagaatatgacccctttcaatccaatacaaatagtttacataa

SEQ ID NO: 135874 - DNA, 4850 bp, Homo sapiens
  Payload ID: 6559
  Gene Symbol: GPR12
  Gene Name: G protein-coupled receptor 12
  Uniprot ID: P47775
  ENST ID: ENST00000405846
  CDS Start-End: 223-1227
aaagctgggcgcgcgagccgaggctgctgctcacctgcagccgcgccgctcacctgccgcggagtgcgcgccccgcgccctcccggcccgctccggagcccggccgccccccccttgccacagcgggcaactgcgccgacatgcgacacgagtagcccacgcgcttcggaagcaccggaggagccccctcggcctgggcgagccaagaggacaggggttaaaatgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattccttgcattggattccctctcaagccacaggagcacttagcattcgtgaaacaatgacatcgttcagatgagttaagtgattgaagtgaaaataatgttaccagtgttttcaccattaaaaaaaattgttgagctctccactcaacattattttgttttgcttgggggcaagggtttccttttatactttgtttggagggctgactgggggtaggaaaggaagggatatgatacgcccatgatgttattagaagtaaatgagtttcagagtttttacctggactttaaaataaatttgagtgattgaggaaaattgagaaagacttactttttccagactattttttttttttacatgatggtagattttttaatgctgcatgtatgtaacagaatatgacccctttcaatccaatacaaatagtttacataattgtgtttggaagggacctgattttgctaacatgaactcagtaatgtcaccgacactgaaaccgtgaacccattcttatccattctttctttcctttcggcaattactgttcacgagaattccttcggtatttctataaatgttgcaactccttctgcatggtcgactgtgttagctagaccacttgtttcaaatgttgccatgtcaatctagattccaacgggtcatttttcaatatagttttccaatatgtactttctaaaatgaatcctgaagtaggttttgatcttcatatgaagtaggattgattagatccaccattgtagtttcttaagctattgtctgattgttttcagaaaacaaaaggaaaaaatattagcaattgagagtagattaaatttattttaatatattctgaaaaaaactaatgtgacattatcatgaaatgaaaaaaatcacctttcctctctctctgagaatatactaatggttattcttgattgagataattagaataaatattataggccaagtttttctggttcatactgtctgtggtgcataatgcatttgaaacaggcagtcccctattttaatgattaggtttgtttgtcagtgcacagcgtccatctatgactgtgacatataccagctatatcctgtaaggtcataaacagaatgaccattggctgttgatgaaaagttaagtttgaaatcttttaactccttttcaccaaaaaccaatttatacacaataaaaatcacattgcctgttttcagagaacaagaatgtagtcaggaaattgcaaagaagaattcactttaaacacattgtaaaatcgatgtgtctcaggtttcttttctgttcatgcagacaaatgtagacgcaggtaccttccctccatttgcaatggatttatagttatgtctatataatcagtggaaaaaattcttggcagcacattaattgagcccattcagatggcagcaaaagcagtatttcagggtcattggggaatcatttgtaataaattaacctcatcggtttgtcccagatgtgatgcccagggtgctctcaagaccattctgggagcctgcatgctgatgccttctctccagagcatcttctaatgtagcacacgtgtgaaaaaatcctctacttgaatctgtgtctcctccctgaggttacttatggaagcaggagagggactgaaatacttaagaagtgggaaagaattttcaatacataccactgtatgatcaatctaataaaactgatgcctttaaaacatttcttttgaacatttgatggagttagtaggttgaacatgatgagtctgttcgtttttaattaattaaaattgaatagcaccaccataggagacttgacaaaggtaagttggttttgagaggggctaggaaatatccgtaatgaggttttaaaggaataaatgatgattttataaaaatagtggctccatttgcatatctccaatagtcagaattataaagagaataatatgtacttgttgtgaccacatgtgtgccaggccccatgctgcgtgttttactataatcacaaaactactacttttataggtgagaaaactaagactaagagaggcgaggataaaaaatgtgcccgaggccacaaagcacaaggatagagtcagaatttgaagccagcttttccaaagtctaagtcttgctccttccctgtaccttgcaagctttcatccctcagtggataccagggctgaggaaactgatttgtaacacgttcctgtcacagagttttggctctacatttaagacataaaacttggcctggcgcagtggctcacgcctgtaatcccagcactttggggggccaaggcaggtggatcacctgaggtcaggagttcgaaaccagcctgaccaatatggcaaaaccctgtctctactaaaaataaaatttagccgggcgtggtggcgggtgcctgtaatcccagctactcaggaggctgaggcaggagaactgcttgaagacaggaggcagaggtagcagtgaacaaagatcgcaccactgcactccagcctgggtgacagagcaagactccatctcaaaaaaaaaaggacataaaatttcctgtttaaagttacactagttacgtggttgcttttggcccatgtttttaaaacatatagtttcagctaagagatttttcagttcaactaacaacatgcctttaccgtttaaattgtgaaaaatgttggatatttatgtggttttctacaaggtttcttttttcctgtggagctaattatttttaaatgtgcacacatctcaatgtacatatgtgtatgtatgtatttatgcatacgtatacccaataatattaactttgcaacaggaccaaagacctcatggaaaactgtcttatttccaacagtcctgaggtagcagataatcttttactccacataattaaaatttctagctaccaaggaattgatatttttccagtagaaacagttatccttgtaactaggacagttccattactttaccagaatcctgaattagtcaaaactagtcatcgaagttatgactatctagggttttgtttccttttattcctttaactctgtatttctttctatcagtgaagtttgtttttaaaggtacctggggcagggaagcagggtggagatagagcccctccttgcctggagcctacagtaaggagccaggttcaggaggagtggattccttggttgacttggccatgcagaaatagtcttagactcccccaggatttaaaataggattgaaacaagaagtttaaaagagcagaggaggaatagagatacttagtgccaataaaaatatcatggagacttcttcggctttttaaaaaaaatgcttaatccattattaaaataatgattgactttattttatagtaatatgtgataatatgaagttaggatgacttgccatttcagatttaaaatacatattaattaagtgactactatgttgtgattttgaataatgtttaagtttctatattgattgtatgcctggtataataaaggaaaagactgccttattgtcccctttaaaa

SEQ ID NO: 135875 - DNA, 3660 bp, Homo sapiens
  Payload ID: 6560
  Gene Symbol: GPR132
  Gene Name: G protein-coupled receptor 132
  Uniprot ID: Q9UNW8
  ENST ID: ENST00000329797
  CDS Start-End: 913-2055
agctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaatttaaccttca

SEQ ID NO: 135876 - DNA, 2887 bp, Homo sapiens
  Payload ID: 6560
  Gene Symbol: GPR132
  Gene Name: G protein-coupled receptor 132
  Uniprot ID: Q9UNW8
  ENST ID: ENST00000392585
  CDS Start-End: 175-1290
acttcctgaaacctcagctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccaggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaattt

SEQ ID NO: 135877 - DNA, 2779 bp, Homo sapiens
  Payload ID: 6560
  Gene Symbol: GPR132
  Gene Name: G protein-coupled receptor 132
  Uniprot ID: Q9UNW8
  ENST ID: ENST00000539291
  CDS Start-End: 1003-2145
agctaggactgcagggaggggtgcgaggctagccacgcaggcggggccctggctttataaaggtataattgacaaacaagaagagtacctaggccaggtgcggtggcttacgcctgtaatcccagcactttgggaggccgaggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacg

SEQ ID NO: 135878 - DNA, 3341 bp, Homo sapiens
  Payload ID: 6560
  Gene Symbol: GPR132
  Gene Name: G protein-coupled receptor 132
  ENST ID: ENST00000551869
  CDS Start-End: 372-578
agggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggtgctgaggccaggtctgtctgcggcttcctgctgacctggaggtgggactccatgatctgtaaccacagaaggcccagaagcatgaactcagccagagtgggcagccaggacactggagctggtggcgctggcagagcttggggaagtcacaccactgcacaccctgcgtgacctctagcaaccccctggctggaaaggatgagtttctgacctcggagagctgtgtttgaggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaa

SEQ ID NO: 135879 - DNA, 1092 bp, Homo sapiens
  Payload ID: 6560
  Gene Symbol: GPR132
  Gene Name: G protein-coupled receptor 132
  ENST ID: ENST00000549990
  CDS Start-End: 1063-1092
gacgttttgatgcctgttggcttggagccttgcttgtgtttctcatgtgggatgcaacggcagattctcaacatttaaaaaacacctacgaatcaacgggccacttagtaaattagtaaatactcactagccgtttgtcaatgggttaacttgtgactcaatctgatttccctaaaacaatttcaacctactctttttccaggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttac

SEQ ID NO: 135880 - DNA, 4578 bp, Homo sapiens
  Payload ID: 6561
  Gene Symbol: GPR135
  Gene Name: G protein-coupled receptor 135
  Uniprot ID: Q8IZ08
  ENST ID: ENST00000395116
  CDS Start-End: 117-1601
ggccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgtaagtgccaaaaatgacaaaaataacattcactataactgaaaagctcatattataggaccacactgtgaaacaaacaaaacattgaatgcaaccagtattgttcaactacacagaatttcaggaatgaatggagaccttcagagctgcttgaaagcccctctaaatcgctaccatccaacaaaactttagcttctagagcttgcacctctgacatgctttgggtgcttagattgcaagtggaaaagtcttatccttacacacattggtgcacctcctcaccccaccccctaataacctttgtggaaaatttttaattcataacccatttaaaatcattttaggattttgaaaagctggttattattagataaaattcaaccatctgaaggacaaatagaagtatgaacataaagaaatgtgtcttttaaatgttttccaagattatatgtaaaaattaacattccttccacccgcgtcatacctccaaaatgatcttccttggaaaactttgaagttttatccttactctaacctgttacttttatttctgataaattttggaatgctgctctcagaatgctttcacatttaaaaaaatattttcattgtagaaaatttttgtcttttgaggtaaatttgatttttggatatagccaaaaatgtaatttgaagtcaagttgattgaataaggtgagtgatgccactttatttaaatttttattattttttaaaatgagacctctataaaacaacaaggttgggtttcctacgtggcttttagctaactgaaaacgattccaaagagaaattctaaaactattttgagaagcagcctcttggaattagcgtagacttttccaaatagatcataccctcctacatttagaaatttggtatattttgtattttttaaaatagctgatggttgctttatagctatgacttgtcgaagataatgtatttattaaagggagaataggtgtgggactatatgtaacggtattaaaacacaggcataaagttggagaagaacttcaagcaaactgaaaatatctttagaaatatgcaaatcaaagatgctttttaaatttctatcttagcagaaaagatggttttacaataattcaaaagcgtatgtgaactttctaatgttaaatacgactatacacagaatcatttactcagaatttttttaaatattatttttccctttcttttcctccatcctgccccttttcttcagtatttcatagccttaattgaacaagttatttacagtagatatgaaaagacattagctgtcgtatgaagatttcaatgtgaaatagccagcattttcttcctgtaaagtatttaaatatgtttttaagtatttctttgtttgacaggtgggtacatgtcattattttgtaatcaaaggtggaaatatatgagtcatgtcagagctaaagatgttttaattttttctgcttctcagggtatcatcacaaatcagaagtttgtaaattgtatatattttgctacactcaatgtagtacaaagtagatgagataatccctcccctctagcccttattttataaagcatatacagacttcatgcagctggactaacaaaaacaggtgtctgcggtatttgcctgttaaaggcaaaaaattgtgtattttttggcaccgagtcacttttgggatttagagagaaatgataaagtcttcaattataaaagacatcatagaatagaagtacagttgtgaataaagggcagagggttagagatcttagagtaaggaggtgagcgtgttgcaaaatagtgtgttgcctgagaagaagaattgaaggaaggcattgaaaaataaatgtgatatagaataaacctacctggtgagtgaagggaaaatctgagagattggaagtgacaaggtgatggcatgaaggactttaaggaagaaaaggaattccagccctaccttttcggtggcaggaagttttaggaaaggcatggcttgtgaaagaggccattctgttagtggctccgagagtcatggtaggcaagaattggaggggaaaaagagaaaattgttcataaattactgaacaatttacaatgctctaaattgtttgtttttaatccaaggctatccaactatttagtggtagaactaggatttgaactgcagtctgtttggcctcagaactccatgtttgtttctctctatccccacagaagtctacaggtaaggaaatcaatcatgatcaattatggtactgtcatcattatcatcatcgtgatcatcatctaccatttttgtttcctactttatataagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcaggtataagtcagccacccatttgacccagtgtaaatacttagacaatcaatacctcaaaaggtgaagaaagaatgattctcaaaataatctaagacttcgacctttcgttgtgcttactatgagtatgcaattatagtgacttcatgggaaaacgagaaagaaaagctatgaaatattggaatggattaaatattgagtactatgtaa

SEQ ID NO: 135881 - DNA, 2540 bp, Homo sapiens
  Payload ID: 6561
  Gene Symbol: GPR135
  Gene Name: G protein-coupled receptor 135
  Uniprot ID: Q8IZ08
  ENST ID: ENST00000481661
  CDS Start-End: 116-1600
gccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgctatccaactatttagtggtagaactaggatttgaactgcagtctgtttggcctcagaactccatgtttgtttctctctatccccacagaagtctacagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcagctcagcatgacagagactccattccaggtggaaaaagcacatggctctttcttctccgagatcccaggactatcttattttcctcagaggggcaggttacaagaacttcacatctctcaggctacatgttgcaaaggttaaattccaggttgtacgatttttcacttccaccatcaagttatgagtgtgattgtttccctgcagttttgccaatagagtgattttagactatttacatcgtgggttacaaccaatgtcagttattctggggaaacccaactgccatgttgtgaggacactcaagcagccctatggaggagcccacatggtgagtgaataactacaagctgactctaattttaaaaaataaaaattttatctctcaccaattttaaaatg

SEQ ID NO: 135882 - DNA, 1485 bp, Homo sapiens
  Payload ID: 6562
  Gene Symbol: GPR137
  Gene Name: G protein-coupled receptor 137
  Uniprot ID: Q96N19
  ENST ID: ENST00000313074
  CDS Start-End: 106-1359
ctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgcccc

SEQ ID NO: 135883 - DNA, 1478 bp, Homo sapiens
  Payload ID: 6562
  Gene Symbol: GPR137
  Gene Name: G protein-coupled receptor 137
  Uniprot ID: Q96N19
  ENST ID: ENST00000377702
  CDS Start-End: 140-1180
gataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccaca

SEQ ID NO: 135884 - DNA, 1495 bp, Homo sapiens
  Payload ID: 6562
  Gene Symbol: GPR137
  Gene Name: G protein-coupled receptor 137
  Uniprot ID: Q96N19
  ENST ID: ENST00000411458
  CDS Start-End: 29-1456
actcggctcaaactctgggatctggaacatgctctgggctgtgaggacaagatgttacgtagtcaaggcacagctggggccaacggtggccctggaaggcagagcaccccgggctccgggccctagttgcttgggcaacgggaactgtcagcgacctggcccaatcacctctcggaacgtcactcgggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagca

SEQ ID NO: 135885 - DNA, 1596 bp, Homo sapiens
  Payload ID: 6562
  Gene Symbol: GPR137
  Gene Name: G protein-coupled receptor 137
  Uniprot ID: Q96N19
  ENST ID: ENST00000438980
  CDS Start-End: 108-1298
atctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccaca

SEQ ID NO: 135886 - DNA, 790 bp, Homo sapiens
  Payload ID: 6562
  Gene Symbol: GPR137
  Gene Name: G protein-coupled receptor 137
  ENST ID: ENST00000546201
  CDS Start-End: 143-562
ggagataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgaga

SEQ ID NO: 135887 - DNA, 998 bp, Homo sapiens
  Payload ID: 6562
  Gene Symbol: GPR137
  Gene Name: G protein-coupled receptor 137
  ENST ID: ENST00000539833
  CDS Start-End: 340-998
gattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgc

SEQ ID NO: 135888 - DNA, 800 bp, Homo sapiens
  Payload ID: 6562
  Gene Symbol: GPR137
  Gene Name: G protein-coupled receptor 137
  ENST ID: ENST00000536667
  CDS Start-End: 706-800
ctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgt

SEQ ID NO: 135889 - DNA, 805 bp, Homo sapiens
  Payload ID: 6562
  Gene Symbol: GPR137
  Gene Name: G protein-coupled receptor 137
  ENST ID: ENST00000543383
  CDS Start-End: 86-805
agttttcttcagagaccgagggacgggaatccgttgccgcccccggccgggcggcacgaccccgatttgggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactg

SEQ ID NO: 135890 - DNA, 431 bp, Homo sapiens
  Payload ID: 6562
  Gene Symbol: GPR137
  Gene Name: G protein-coupled receptor 137
  ENST ID: ENST00000542190
  CDS Start-End: 14-431
ctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttcggttctcagg

SEQ ID NO: 135891 - DNA, 350 bp, Homo sapiens
  Payload ID: 6562
  Gene Symbol: GPR137
  Gene Name: G protein-coupled receptor 137
  ENST ID: ENST00000538244
  CDS Start-End: 162-350
tctcctccactagctctgagtggggccacaggaccactacgcttgccggacacaaggccccacaggtggaagagggagtcttgctttgtcacccaggctggagtacagtgatgtgatcttggctcactgcaacctctgctcaccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctg

SEQ ID NO: 135892 - DNA, 1843 bp, Homo sapiens
  Payload ID: 6562
  Gene Symbol: GPR137
  Gene Name: G protein-coupled receptor 137
  Uniprot ID: Q96N19
  ENST ID: ENST00000539851
  CDS Start-End: 468-1430
ggatccaaggctcctcgtccgcatcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacagttgtg

SEQ ID NO: 135893 - DNA, 473 bp, Homo sapiens
  Payload ID: 6562
  Gene Symbol: GPR137
  Gene Name: G protein-coupled receptor 137
  ENST ID: ENST00000541952
  CDS Start-End: 5-473
tgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgcgggcgccctccactagcatctacctggaggccaaggggaccagtgtgtgccaggcggccg

SEQ ID NO: 135894 - DNA, 362 bp, Homo sapiens
  Payload ID: 6562
  Gene Symbol: GPR137
  Gene Name: G protein-coupled receptor 137
  ENST ID: ENST00000536282
  CDS Start-End: 1-266
gaacaaaggctacctggtatttggcctcatcctcttcgtgtgggagctactgcccaccaccctgctggtgggcttcttccgggtgcaccggcccccacaggacctgtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgg

SEQ ID NO: 135895 - DNA, 560 bp, Homo sapiens
  Payload ID: 6562
  Gene Symbol: GPR137
  Gene Name: G protein-coupled receptor 137
  ENST ID: ENST00000538032
  CDS Start-End: 60-560
gtaaccccgggcgcccgccagcggcgcagctcgcgccaattctcgcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacag

SEQ ID NO: 135896 - DNA, 1274 bp, Homo sapiens
  Payload ID: 6562
  Gene Symbol: GPR137
  Gene Name: G protein-coupled receptor 137
  ENST ID: ENST00000546139
  CDS Start-End: 598-1274
ggaagggaatctgggtcagccctccctccaaaggagacagcacggatcctctttttgcataggcctgagggaagtacttccgcccatattcaagatggctgcccagggcagtgggaacgggtggagtttcgggatgtggagcgaaggtcactgggagggggcggagcttcccctgcccaagttccgatcccaccaggactggaagactcgcgtccagctggagctttgccgcatctgcgttgctgtgcccgcgctcttcgggcgaggaagtcccttctggtggagggagaaaagggttacatgagttagattaccatggcagctcgagccaggctctccacttccgtgagccttcctctaagtgagatcgggggggagataatgaaggccacaactcccaggaggctccacgccgggcggtcagggacgctcgcgaggacgcatgggcccccaggaatgggaactggttagatcccaggaactccgtgccggagacgggaagagaggatgcctagggccctaaatggaaaggccagagctggagacctagcacccagaagatgagaccgcaattcgagaatcaaagggccgggagcgatggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgc

SEQ ID NO: 135897 - DNA, 542 bp, Homo sapiens
  Payload ID: 6562
  Gene Symbol: GPR137
  Gene Name: G protein-coupled receptor 137
  ENST ID: ENST00000535675
  CDS Start-End: 147-542
atcttggctatgggcggaagttttcttcagagaccgagggacgggaatccgttgccgcccccggccgggcggcacgaccccgatttgggtataggagagaggagcgtgggaactggcggacccccatacaagcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatg

SEQ ID NO: 135898 - DNA, 527 bp, Homo sapiens
  Payload ID: 6562
  Gene Symbol: GPR137
  Gene Name: G protein-coupled receptor 137
  ENST ID: ENST00000540370
  CDS Start-End: 292-527
agccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctcctt

SEQ ID NO: 135899 - DNA, 1114 bp, Homo sapiens
  Payload ID: 6562
  Gene Symbol: GPR137
  Gene Name: G protein-coupled receptor 137
  ENST ID: ENST00000621779
  CDS Start-End: 416-1051
agcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccggcgggcgccctccactagcatctacctggaggccaaggtagggctgcagcactgatgcccaggtgtcttttgggtctctcggcagcggttctcagggtgtagag

SEQ ID NO: 135900 - DNA, 2042 bp, Homo sapiens
  Payload ID: 6563
  Gene Symbol: GPR137B
  Gene Name: G protein-coupled receptor 137B
  Uniprot ID: O60478
  ENST ID: ENST00000366592
  CDS Start-End: 92-1291
gcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcacaga

SEQ ID NO: 135901 - DNA, 1104 bp, Homo sapiens
  Payload ID: 6563
  Gene Symbol: GPR137B
  Gene Name: G protein-coupled receptor 137B
  ENST ID: ENST00000454895
  CDS Start-End: 1-692
tgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgca

SEQ ID NO: 135902 - DNA, 1107 bp, Homo sapiens
  Payload ID: 6563
  Gene Symbol: GPR137B
  Gene Name: G protein-coupled receptor 137B
  ENST ID: ENST00000419162
  CDS Start-End: 119-661
gaatcatgtggtgccgggggaggaagtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatg

SEQ ID NO: 135903 - DNA, 3888 bp, Homo sapiens
  Payload ID: 6564
  Gene Symbol: GPR137C
  Gene Name: G protein-coupled receptor 137C
  Uniprot ID: Q8N3F9
  ENST ID: ENST00000321662
  CDS Start-End: 1-1290
atgagggtgtccgtgccgggtccggcggccgctgccgcccccgcagccggccgcgagccctccacgcccggcgggggcagcggaggcggaggcgccgtcgctgcagcctcaggcgccgcggtgccgggctccgtgcagttggcgctgagcgtcctgcacgccctgctctacgccgcgctgttcgcctttgcctacctgcagctgtggcggctgctcctgtaccgcgagcggcggctgagttaccagagcctctgcctcttcctctgtctcctgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgtcccagaaaatcagttgaagtggactgtgtttgttcgagcattaattaatgatagcctgtttattctttgtgccatctctttagtgtgttacatatgcaaaattacaaaaatgtcatcagctaatgtctacctcgaatcaaagggtatgtctctgtgccagactgtcgtcgtgggctctgtagtcattcttctgtactcttccagagcttgttataatttggtggtggtcaccatatctcaggatacattagaaagtccatttaattatggctgggataatctttcagataaggctcatgtagaagacataagtggagaagagtatatagtatttggaatggtcctctttctgtgggaacatgtgccagcatggtcggtggtactgtttttccgggcacagagattaaaccagaatttggcacctgctggcatgataaatagtcacagttatagttccagagcttactttttcgacaatccaagacgatatgatagtgatgatgacctgccaagactgggaagttcaagagaaggaagtttaccaaattcgcaaagtttgggctggtatggcaccatgactgggtgtggcagcagcagttacacagtcactccccacctgaatggacctatgacagatactgctcctttgctctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaattttatagtgtgaacagtgcacagagttaaggcataaaaatgtatcattctttataaaaatctactgaaaatgtgtaatcattgaagacagttcttttaagcatgattttaaaatagcaactgaaattcaatcattttaaacaaatgatggtagtaatccattagttatggccagcagtgttctttggagagccacaataatttcaagaggaaaatataccagtgaaaattgtgtggctattttgagtagaattggtcagttgattattttgtgtaattgagatatatgtagtagtttaagcatgattcttgaagaaagcaatagtgacttttgcatagggagattttggtagaaacttcttgggactaaacaagtttagagatgcatttaagaattattcacaaaatgtgtaattctaaattaaaacataaatatattttcaaaagcatttgatttctctgaagcatgatatagctggtcttacctagtgaatcaggattgtcctcaggtaaatgaaatcatgatacattattgcagtgaactcaagtgcaatactttgtaagacatataattcctatgattttcacatttttatatcttatatatgggaaaagccaaattaaattgaattcagattaattccagcattagactaaatgagcaaacttaagtaaatgtacaaactaggtaagtataaaaccacaggttaacaatattggagtacttttagaattacattaaaactgtcttaaatgtcctatcccaaatctaaaaaaaaagaaaatggcaggctgagataatacagaattttaaaatgcactttgtaccagtgtctatatggaaagaagtagatgctgaatacctcaagatgccaagggaacaagcaacattgggaagttgtcacaacatgctcaaagacaaactacaattgtctgctagctatttcttcagaactggaactaatacgactatccttttctgttttatactttgattagaatgttatttcctcgcttacttaaaatgtacttcaactttttaacaactgatacaataacttcataaaagtataacactaggttgaaaccttaaggaaaaattgaaattgttaatgctttcgatcttttgggaggccagtacacagacaaataaatttcttctttttatgatacaaaatgactttgtattcaatcagaagcatatacttatgttattttgggtttgtttataattctctcattgtaaccaaattattttaaaatgtatagtataaaaagttacccgtggtattaagtgacaaaagcgtacttttattacaactccagttgttagattgcttctcagaatgctaactgtttattttgctaataatgttaggcatctaatcatctagagctgtccaaaaagatatgttgtctttgttaatccttggggttcaaggtgataaagtttttctagtaaggctcccctcgataatgttcctatttgaccaaactaacaaagattactttttaaaaatttttcagataaaataacttggttctttctgctgcattagttgattgttccaaatttgaggtttgtaagtttattcttatcactgactagggtacccaaattcttgcatttgtctccttatacacatctaacatatcaccaaagacaaataaagatacactctggcccaatctttgcttaaaaattccaaagcactaggagcactttaagtttggtctcgaaaggagttgtttataaaatcaaagggctaccgattccctgttcatcctgcactgaagcacatgatgacagtatcaaaccttcatttttgttcattaaaaagtgaatttcattacttaagtgtgtaattctatagtgattagcagtatttgttttcatcatttcacttgggtggccattaattttgaaacctttaccactcattgtagttggttgtagttttatggaaaatgtaatttatagctaaagtggcttttttatgcatagctgccttttttattgtttaacagtgtttctcagctatataatcagtttcaaactggttgtaaaagtatagctgtggccaatgaatgtatttatttgttgtttcactaaattgtaacaaaacactactattaaaaataaaagtgtttgtgctttta

SEQ ID NO: 135904 - DNA, 2808 bp, Homo sapiens
  Payload ID: 6564
  Gene Symbol: GPR137C
  Gene Name: G protein-coupled receptor 137C
  ENST ID: ENST00000542169
  CDS Start-End: 1-1198
ggcgctgagcgtcctgcacgccctgctctacgccgcgctgttcgcctttgcctacctgcagctgtggcggctgctcctgtaccgcgagcggcggctgagttaccagagcctctgcctcttcctctgtctcctgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgtcccagaaaatcagttgaagtggactgtgtttgttcgagcattaattaatgatagcctgtttattctttgtgccatctctttagtgtgttacatatgcaaaattacaaaaatgtcatcagctaatgtctacctcgaatcaaagattacaggatctcattctttcttatggctgaatagtactccattgtgtggtatgtctctgtgccagactgtcgtcgtgggctctgtagtcattcttctgtactcttccagagcttgttataatttggtggtggtcaccatatctcaggatacattagaaagtccatttaattatggctgggataatctttcagataaggctcatgtagaagacataagtggagaagagtatatagtatttggaatggtcctctttctgtgggaacatgtgccagcatggtcggtggtactgtttttccgggcacagagattaaaccagaatttggcacctgctggcatgataaatagtcacagttatagttccagagcttactttttcgacaatccaagacgatatgatagtgatgatgacctgccaagactgggaagttcaagagaaggaagtttaccaaattcgcaaagtttgggctggtatggcaccatgactgggtgtggcagcagcagttacacagtcactccccacctgaatggacctatgacagatactgctcctttgctctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaattttatagtgtgaacagtgcacagagttaaggcataaaaatgtatcattctttataaaaatctactgaaaatgtgtaatcattgaagacagttcttttaagcatgattttaaaatagcaactgaaattcaatcattttaaacaaatgatggtagtaatccattagttatggccagcagtgttctttggagagccacaataatttcaagaggaaaatataccagtgaaaattgtgtggctattttgagtagaattggtcagttgattattttgtgtaattgagatatatgtagtagtttaagcatgattcttgaagaaagcaatagtgacttttgcatagggagattttggtagaaacttcttgggactaaacaagtttagagatgcatttaagaattattcacaaaatgtgtaattctaaattaaaacataaatatattttcaaaagcatttgatttctctgaagcatgatatagctggtcttacctagtgaatcaggattgtcctcaggtaaatgaaatcatgatacattattgcagtgaactcaagtgcaatactttgtaagacatataattcctatgattttcacatttttatatcttatatatgggaaaagccaaattaaattgaattcagattaattccagcattagactaaatgagcaaacttaagtaaatgtacaaactaggtaagtataaaaccacaggttaacaatattggagtacttttagaattacattaaaactgtcttaaatgtcctatcccaaatctaaaaaaaaagaaaatggcaggctgagataatacagaattttaaaatgcactttgtaccagtgtctatatggaaagaagtagatgctgaatacctcaagatgccaagggaacaagcaacattgggaagttgtcacaacatgctcaaagacaaactacaattgtctgctagctatttcttcagaactggaactaatacgactatccttttctgttttatactttgattagaatgttatttcctcgcttacttaaaatgtacttcaactttttaacaactgatacaataacttcataaaagtataacactaggttgaaaccttaaggaaaaattgaaattgttaatgctttcgatcttttgggaggccagtacacagacaaataaatttcttctttttatgata

SEQ ID NO: 135905 - DNA, 613 bp, Homo sapiens
  Payload ID: 6564
  Gene Symbol: GPR137C
  Gene Name: G protein-coupled receptor 137C
  ENST ID: ENST00000555622
  CDS Start-End: 1-613
tgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggtgctgcagactggagctgttcctatttggccatcttggaaggaacccatcttatatctccaaatggttatatgtaaagtcagatgtgccactgaacttgacagacacaaaattctactgcatttgggctttataatggcaagcctgctctttttagtggtgaacttgacttgcgcaatgctagttcatggagatgtcccagaaaatcagttgaagtggactgtgtttgttcgagcattaattaatgatagcctgtttattctttgtgccatctctttagtgtgttacatatgcaaaattacaaaaatgtcatcagctaatgtctacctcgaatcaaagggtatgtctctgtgccagactgtcgtcgtgggctctgtagtcattcttctgtactcttccagagcttgttataatttggtggtggtcaccatatctcagga

SEQ ID NO: 135906 - DNA, 1388 bp, Homo sapiens
  Payload ID: 6565
  Gene Symbol: GPR139
  Gene Name: G protein-coupled receptor 139
  ENST ID: ENST00000326571
  CDS Start-End: 152-304
atcacggccaagggtaggagccagtcctgcggggagagaggcgctgctgctccagctgccgctgcctccgccgccgccaccaccgagccggcgaccagagtcgggctggcaggccgggcgcgaagcggcaaggggagcgaggggcgcgctcatggagcacacgcacgcccacctcgcagccaacagctcgctgtcttggtggtcccccggctcggcctgcggcttgggtttcgtgcccgtggtctactacagcctcttgctgtgcctcggtttaccagatatcatgaagccgatcaagttgtaaggagggcggtctgcttgctcagccccaccagtgaccagaggagggactgagatacacagaagaaagcattcagcaaatatcttgacagtgatcatcctctcccagctggtggcaagaagacagaagtcctcctacaactatctcttggcactcgctgctgccgacatcttggtcctctttttcatagtgtttgtggacttcctgttggaagatttcatcttgaacatgcagatgcctcaggtccccgacaagatcatagaagtgctggaattctcatccatccacacctccatatggattactgtaccgttaaccattgacaggtatatcgctgtctgccacccgctcaagtaccacacggtctcatacccagcccgcacccggaaagtcattgtaagtgtttacatcacctgcttcctgaccagcatcccctattactggtggcccaacatctggactgaagactacatcagcacctctgtgcatcacgtcctcatctggatccactgcttcaccgtctacctggtgccctgctccatcttcttcatcttgaactcaatcattgtgtacaagctcaggaggaagagcaattttcgtctccgtggctactccacggggaagaccaccgccatcttgttcaccattacctccatctttgccacactttgggccccccgcatcatcatgattctttaccacctctatggggcgcccatccagaaccgctggctggtacacatcatgtccgacattgccaacatgctagcccttctgaacacagccatcaacttcttcctctactgcttcatcagcaagcggttccgcaccatggcagccgccacgctcaaggctttcttcaagtgccagaagcaacctgtacagttctacaccaatcataacttttccataacaagtagcccctggatctcgccggcaaactcacactgcatcaagatgctggtgtaccagtatgacaaaaatggaaaacctataaaagtatccccgtgattccataggtgtggcaactactgcctctgtctaatccatttccagatgggaaggtgtcccatcctatggctgagca

SEQ ID NO: 135907 - DNA, 1613 bp, Homo sapiens
  Payload ID: 6565
  Gene Symbol: GPR139
  Gene Name: G protein-coupled receptor 139
  Uniprot ID: Q6DWJ6
  ENST ID: ENST00000570682
  CDS Start-End: 302-1363
gtggagcgggtccgaggtgggaggcgcacagacgggctccgggagcccctcccgaggccccgcgcagcgcgccccgcaccctgcgccccgcgccctgcgggagggctgagccaagactccaggcgggcaggtgcggagcgagcagaggggatcacggccaagggtaggagccagtcctgcggggagagaggcgctgctgctccagctgccgctgcctccgccgccgccaccaccgagccggcgaccagagtcgggctggcaggccgggcgcgaagcggcaaggggagcgaggggcgcgctcatggagcacacgcacgcccacctcgcagccaacagctcgctgtcttggtggtcccccggctcggcctgcggcttgggtttcgtgcccgtggtctactacagcctcttgctgtgcctcggtttaccagcaaatatcttgacagtgatcatcctctcccagctggtggcaagaagacagaagtcctcctacaactatctcttggcactcgctgctgccgacatcttggtcctctttttcatagtgtttgtggacttcctgttggaagatttcatcttgaacatgcagatgcctcaggtccccgacaagatcatagaagtgctggaattctcatccatccacacctccatatggattactgtaccgttaaccattgacaggtatatcgctgtctgccacccgctcaagtaccacacggtctcatacccagcccgcacccggaaagtcattgtaagtgtttacatcacctgcttcctgaccagcatcccctattactggtggcccaacatctggactgaagactacatcagcacctctgtgcatcacgtcctcatctggatccactgcttcaccgtctacctggtgccctgctccatcttcttcatcttgaactcaatcattgtgtacaagctcaggaggaagagcaattttcgtctccgtggctactccacggggaagaccaccgccatcttgttcaccattacctccatctttgccacactttgggccccccgcatcatcatgattctttaccacctctatggggcgcccatccagaaccgctggctggtacacatcatgtccgacattgccaacatgctagcccttctgaacacagccatcaacttcttcctctactgcttcatcagcaagcggttccgcaccatggcagccgccacgctcaaggctttcttcaagtgccagaagcaacctgtacagttctacaccaatcataacttttccataacaagtagcccctggatctcgccggcaaactcacactgcatcaagatgctggtgtaccagtatgacaaaaatggaaaacctataaaagtatccccgtgattccataggtgtggcaactactgcctctgtctaatccatttccagatgggaaggtgtcccatcctatggctgagcagctctccttaagagtgctaatccgatttcctgtctcccgcagactgggcaattctcagactggtagatgagaagagatggaagagaagaaaggagagcatgaagcttgtttttacttatgcatttatttccacagagtcgtaatgacagcaaaagctcctaccagtttgaagat

SEQ ID NO: 135908 - DNA, 918 bp, Homo sapiens
  Payload ID: 6566
  Gene Symbol: GPR141
  Gene Name: G protein-coupled receptor 141
  Uniprot ID: Q7Z602
  ENST ID: ENST00000334425
  CDS Start-End: 1-918
atgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttag

SEQ ID NO: 135909 - DNA, 1270 bp, Homo sapiens
  Payload ID: 6566
  Gene Symbol: GPR141
  Gene Name: G protein-coupled receptor 141
  Uniprot ID: Q7Z602
  ENST ID: ENST00000447769
  CDS Start-End: 290-1207
gtagccatcactgagaaatctggattttcaagcaatgattttcaacaattataaaatggaagttgtagactggataagagatgctcagctaagggagttcctggatggtctttagattgatacaccaatcctctgaaattgcatgcaaaaatgttttcctgggatcagctgcactccttagcaaaagtatattggagaatcaactgagaaagtaactgagacatttcaatcatttctaggtgtaaagaaagaccagatcccaggaaaatattacggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttagccacaaactacagtattcatatttgcttcctttatattgggaataaaaatgggtataggggag

SEQ ID NO: 135910 - DNA, 677 bp, Homo sapiens
  Payload ID: 6566
  Gene Symbol: GPR141
  Gene Name: G protein-coupled receptor 141
  ENST ID: ENST00000450180
  CDS Start-End: 366-677
gagcatggaaatgacccagctgccctgctgttgaaacagaatcctatttggaaggcagacatgtggcccatctctgtagccatcactgagaaatctggattttcaagcaatgattttcaacaattataaaatggaagttgtagactggataagagatgctcagctaagggagttcctggatggtctttagattgatacaccaatcctctgaaattgcatgcaaaaatggcctttctctctgttgcccaggctggagtttagcgactcaatcatggctcactgactgcagcatcgacctccggggctcaagtgatcctttcatctcagcctcctcagtagctgagactacaggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttccta

SEQ ID NO: 135911 - DNA, 1437 bp, Homo sapiens
  Payload ID: 6567
  Gene Symbol: GPR142
  Gene Name: G protein-coupled receptor 142
  Uniprot ID: Q7Z601
  ENST ID: ENST00000335666
  CDS Start-End: 49-1437
catctccaggctccatctcttgaaccatggatcccagcgttgttagcaatgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggctcagtgtctgcgtaaggatcctggggcaaacaaccacttggagagccaaggggtgagaggtacagctggcgatgctgacagggagctgcggggaccctcagaaaaagccacagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctgtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaatatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtag

SEQ ID NO: 135912 - DNA, 729 bp, Homo sapiens
  Payload ID: 6567
  Gene Symbol: GPR142
  Gene Name: G protein-coupled receptor 142
  ENST ID: ENST00000585308
  CDS Start-End: 49-444
catctccaggctccatctcttgaaccatggatcccagcgttgttagcaatgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggctcagtgtctgcgtaaggatcctggggcaaacaaccacttggagagccaaggggtgagaggtacagctggcgatgctgacagggagctgcggggaccctcagaaaaagccacaggtgacccaggactcagggccccagagcatggggcttgagggacgagagacagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctgtcagcctcctgaccgcagtggccctggcgcgccttgccaccaggaccaggaggccctcctactactaccttctggcgctcacagcctcggatatcatcatccaggtggtcat

SEQ ID NO: 135913 - DNA, 1608 bp, Homo sapiens
  Payload ID: 6567
  Gene Symbol: GPR142
  Gene Name: G protein-coupled receptor 142
  ENST ID: ENST00000582579
  CDS Start-End: 100-405
tggctgatgacgtggttgccctgtcctgtctgctgctgccactgagctggacatctccaggctccatctcttgaaccatggatcccagcgttgttagcaatgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggtgaatccagctgcctcccagaacaggccttctatggggtgggatggctcagtgtctgcgtaaggatcctggggcaaacaaccacttggagagccaaggggtgagaggtacagctggcgatgctgacagggagctgcggggaccctcagaaaaagccacaggtgacccaggactcagggccccagagcatggggcttgagggacgagagacagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctgtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaatatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtagaggagggggcccagctagggag

SEQ ID NO: 135914 - DNA, 859 bp, Homo sapiens
  Payload ID: 6568
  Gene Symbol: GPR143
  Gene Name: G protein-coupled receptor 143
  ENST ID: ENST00000447366
  CDS Start-End: 59-859
taccgcggggccggtcacggggagcgcgtccagaggtccagcccgcggcccgaagggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccct

SEQ ID NO: 135915 - DNA, 587 bp, Homo sapiens
  Payload ID: 6568
  Gene Symbol: GPR143
  Gene Name: G protein-coupled receptor 143
  ENST ID: ENST00000431126
  CDS Start-End: 73-587
taaagatggcaggtttggcgctctaggtggcagagaaaccaccaggaaggcttggtgaatggggagaaaggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttg

SEQ ID NO: 135916 - DNA, 1762 bp, Homo sapiens
  Payload ID: 6568
  Gene Symbol: GPR143
  Gene Name: G protein-coupled receptor 143
  Uniprot ID: P51810
  ENST ID: ENST00000467482
  CDS Start-End: 148-1362
accgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactgagctctcagcctgacttggattctgtcttaacacttctagcaaaagaaaataaatacatgtacagtta

SEQ ID NO: 135917 - DNA, 1757 bp, Homo sapiens
  Payload ID: 6569
  Gene Symbol: GPR146
  Gene Name: G protein-coupled receptor 146
  Uniprot ID: Q96CH1
  ENST ID: ENST00000297468
  CDS Start-End: 12-1013
cgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatccgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtg

SEQ ID NO: 135918 - DNA, 1969 bp, Homo sapiens
  Payload ID: 6569
  Gene Symbol: GPR146
  Gene Name: G protein-coupled receptor 146
  Uniprot ID: Q96CH1
  ENST ID: ENST00000397095
  CDS Start-End: 224-1225
aagtgcttgcatcctggggccctcacacgcacgcgcaggcggccaggcgcgctgctgataagagcctgcgggtttgcagagaagcgcagcagcgcgcaggtcctcaccagagctctggtggccacctctgtcccgccatgctgctcaccgacagtggccagggcccacagcaccaagaggcttgggccacaaagtaaagggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatccgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtg

SEQ ID NO: 135919 - DNA, 313 bp, Homo sapiens
  Payload ID: 6569
  Gene Symbol: GPR146
  Gene Name: G protein-coupled receptor 146
  ENST ID: ENST00000427680
  CDS Start-End: 198-313
ccagtggcgggtgaggacccactcccgcagccggcctcctcactgctcttgcctccgggcatgggaacgatgccgtctgctcgtctgcctgagacgctttctactccactccgagagtaggaggtcagccggggccaaatgacatggtggacatcaggcttcccgagatagctggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgcc

SEQ ID NO: 135920 - DNA, 1053 bp, Homo sapiens
  Payload ID: 6569
  Gene Symbol: GPR146
  Gene Name: G protein-coupled receptor 146
  ENST ID: ENST00000444847
  CDS Start-End: 108-1053
gtgcgcgccgtgagccccgccgcctccgccagcccgagctgcccgcccggcggcgactgcgccggccgccgcccagcaagccgggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccct

SEQ ID NO: 135921 - DNA, 1267 bp, Homo sapiens
  Payload ID: 6570
  Gene Symbol: GPR148
  Gene Name: G protein-coupled receptor 148
  Uniprot ID: Q8TDV2
  ENST ID: ENST00000309926
  CDS Start-End: 83-1126
gacccctgtggggcagatcaacactcaaggcaggtgcagaatcaacaacctgtgacaaagccagccatccctgccaggaagcatgggggatgagctggcaccttgccctgtgggcactacagcttggccggccctgatccagctcatcagcaagacaccctgcatgccccaagcagccagcaacacttccttgggcctgggggacctcagggtgcccagctccatgctgtactggcttttccttccctcaagcctgctggctgcagccacactggctgtcagccccctgctgctggtgaccatcctgcggaaccaacggctgcgacaggagccccactacctgctcccggctaacatcctgctctcagacctggcctacattctcctccacatgctcatctcctccagcagcctgggtggctgggagctgggccgcatggcctgtggcattctcactgatgctgtcttcgccgcctgcaccagcaccatcctgtccttcaccgccattgtgctgcacacctacctggcagtcatccatccactgcgctacctctccttcatgtcccatggggctgcctggaaggcagtggccctcatctggctggtggcctgctgcttccccacattccttatttggctcagcaagtggcaggatgcccagctggaggagcaaggagcttcatacatcctaccaccaagcatgggcacccagccgggatgtggcctcctggtcattgttacctacacctccattctgtgcgttctgttcctctgcacagctctcattgccaactgtttctggaggatctatgcagaggccaagacttcaggcatctgggggcagggctattcccgggccaggggcaccctgctgatccactcagtgctgatcacattgtacgtgagcacaggggtggtgttctccctggacatggtgctgaccaggtaccaccacattgactctgggactcacacatggctcctggcagctaacagtgaggtactcatgatgcttccccgtgccatgctcacatacctgtacctgctccgctaccggcagctgttgggcatggtccggggccacctcccatccaggaggcaccaggccatctttaccatttcctagagttcttgagtccacagtctggcaagctgaggttaaaaatcatatgttgaatgcagcagtgtccacttatgactaacttcttagaacagcacaatataatagtggaattgggcctttcagaagacctcaactgatgatttt

SEQ ID NO: 135922 - DNA, 2323 bp, Homo sapiens
  Payload ID: 6571
  Gene Symbol: GPR149
  Gene Name: G protein-coupled receptor 149
  Uniprot ID: Q86SP6
  ENST ID: ENST00000389740
  CDS Start-End: 101-2296
cttggtaggaggaatgaaatctgatttgcagcagccggtctttcttttgagaaaattatcagactcattgataagggaaattaaatattgaccaaggacaatgtctttatttctcagtaacttatcaacaaatgactctagcctgtggaaagagaatcataattctacggaccttttaaatccgccaggaaccctgaatatctatcttttttgcttgacatgtctcatgacttttgcagccttggtgggcagcatttattcactaatttccctgctgaaaatgcagaacagaactgttgtgtccatgcttgtggcttcctggtctgtggatgatctcatgagcgtcctgtcggtgaccatcttcatgtttttgcagtggccaaacgaggtccccggttacttccaatttctgtgcaccacctctgccttaatgtatttatgccagggcctctctagcaacttgaaggcgactctcctagtctcttacaacttttatacgatgcacagaggtgtggggagccagacagcctccagaagatcgggccaggtgctcggcgtggtgctgaccgtgtgggcagccagtctgctgctctcggcgctcccgctgtgcggctggggcgccttcgtgcgcacgccctggggctgcctggtggactgctccagctcctacgtactattcctctctatcgtgtacgctttggccttcggactcctcgtgggcctctcagtcccactcactcaccgattgctgtgttcggaggagccgccgagactccactccaactaccaggaaatttcccgtggagcttcaattcctgggacccctcctactgcggggagagtggtttccctgtccccagaggatgctccaggcccgagtctgcggcgctctgggggatgctctccgagctccgacaccgtgttcggaccgggtgcgcccgctgccgctggggctgaagcctgcaggcgtgagaaccgggggactctctatggcaccaggagcttcaccgtgagcgtagcgcagaagcgcttcgctttgatcctagcgcttacaaaagtcgtcctttggctgcccatgatgatgcacatggtggtccagaacgtcgtggggtttcagagccttcccttggagacattcagctttctacttaccctgctggccaccactgtaaccccagtgtttgtcttgtccaaacgctggacccacttgccctgtggctgcatcatcaactgcaggcagaacgcatatgcagtggcgtccgatgggaaaaaaatcaagagaaaaggctttgaattcaatctatcattccaaaaaagttatgggatttataaaatagcacatgaagattactatgatgatgatgaaaattccatattctatcacaacctgatgaactctgagtgtgaaactacaaaagaccctcagagagacaaccgtaacatcttcaatgctataaaagtagaaatcagcaccacgccctctctggacagctccacacaaagaggcatcaacaaatgcacaaatactgatattacagaagctaaacaggattccaacaacaaaaaggatgcgttttctgacaaaacaggaggtgatattaactatgaagaaactaccttttctgaagggccagaaagaagactgtctcatgaagagagtcagaaaccagatctttcagactgggagtggtgtaggagtaaatcagaaagaacccctcgtcagcgttccggttatgcccttgccattcccttgtgtgcattccaggggactgtgtctctccatgcacctacagggaaaaccctatctctttctacctatgaggtaagcgcagaagggcaaaaaataactccagcctctaagaaaatagaagtctatcgatccaaaagtgttggccatgaaccaaactcagaagattcttcatccacgtttgtggacaccagtgtgaaaatacacttggaggttcttgaaatttgtgataatgaagaggccttggacactgtgtcaatcattagtaacatcagtcagtcctccacacaagtcagatctccatccctacgttactccaggaaagaaaacagatttgtttcatgtgacctaggggaaacagcctcatactccctctttttgcccaccagtaatcctgatggtgatattaatatctccattccagacacagtagaagcacacaggcagaacagtaaaaggcagcatcaagagagggatggctaccaggaggaaatccagttgttaaataaagcttacagaaaaagagaggaagaaagcaagggtagttagtgggtatttggtctaacaggagcaaga

SEQ ID NO: 135923 - DNA, 1252 bp, Homo sapiens
  Payload ID: 6572
  Gene Symbol: GPR15
  Gene Name: G protein-coupled receptor 15
  Uniprot ID: P49685
  ENST ID: ENST00000284311
  CDS Start-End: 136-1218
gatctttaaagggaggggaaaaaagagagagagaggcaggcactgtataaaagaagcttccttgaggtttctaaaatttatacaaaaacatcatatgtaagtaaactcaccagatttggcatctgctctttggtgatggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaaagggaactgtgacatttcaagctctgttggtggg

SEQ ID NO: 135924 - DNA, 2065 bp, Homo sapiens
  Payload ID: 6573
  Gene Symbol: GPR150
  Gene Name: G protein-coupled receptor 150
  Uniprot ID: Q8NGU9
  ENST ID: ENST00000380007
  CDS Start-End: 199-1503
caaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttctaggtgcttggtggtcagagacgggtcatctgtcgctaaggcgcaacctccagggaactcgaggcctgccagggtctgtccagatcacaaggggcaggagagtctgtgagagagtgacactgaagttgtccccttcctccactctcctattcccttctcatgtttacatttccctatgctcttccagtttctcttcttccctacagttcctctcatatctccccatttggagacagtgagccactggaaagttgtaaaaacaaaaacagttatttttgcagttttctttcacgcatttatagtgctctggataatgccatttatttttgctgattacccaactttcagtatttgctgtgttatcatctgtatttacttattttgaatcgtgcttaaatcaaatgtaccttcagcacctgcaagtttgccttttctttccaggaggaaaatccccacgttgctctccctggggagtctgagaattataccagtgctgtcagaaatgtaatcatgctgtcatttcagagccacagagtatttataaaataaaaacctttcccacgga

SEQ ID NO: 135925 - DNA, 3088 bp, Homo sapiens
  Payload ID: 6574
  Gene Symbol: GPR151
  Gene Name: G protein-coupled receptor 151
  Uniprot ID: Q8TDV0
  ENST ID: ENST00000311104
  CDS Start-End: 78-1337
tttcctatgcaaaagagcccaggcagaaagacaaacctaaataagaatctaacttctgtaagaagctgtgaagagtgatgctggcagctgcctttgcagactctaactccagcagcatgaatgtgtcctttgctcacctccactttgccggagggtacctgccctctgattcccaggactggagaaccatcatcccggctctcttggtggctgtctgcctggtgggcttcgtgggaaacctgtgtgtgattggcatcctccttcacaatgcttggaaaggaaagccatccatgatccactccctgattctgaatctcagcctggctgatctctccctcctgctgttttctgcacctatccgagctacggcgtactccaaaagtgtttgggatctaggctggtttgtctgcaagtcctctgactggtttatccacacatgcatggcagccaagagcctgacaatcgttgtggtggccaaagtatgcttcatgtatgcaagtgacccagccaagcaagtgagtatccacaactacaccatctggtcagtgctggtggccatctggactgtggctagcctgttacccctgccggaatggttctttagcaccatcaggcatcatgaaggtgtggaaatgtgcctcgtggatgtaccagctgtggctgaagagtttatgtcgatgtttggtaagctctacccactcctggcatttggccttccattattttttgccagcttttatttctggagagcttatgaccaatgtaaaaaacgaggaactaagactcaaaatcttagaaaccagatacgctcaaagcaagtcacagtgatgctgctgagcattgccatcatctctgctctcttgtggctccccgaatgggtagcttggctgtgggtatggcatctgaaggctgcaggcccggccccaccacaaggtttcatagccctgtctcaagtcttgatgttttccatctcttcagcaaatcctctcatttttcttgtgatgtcggaagagttcagggaaggcttgaaaggtgtatggaaatggatgataaccaaaaaacctccaactgtctcagagtctcaggaaacaccagctggcaactcagagggtcttcctgacaaggttccatctccagaatccccagcatccataccagaaaaagagaaacccagctctccctcctctggcaaagggaaaactgagaaggcagagattcccatccttcctgacgtagagcagttttggcatgagagggacacagtcccttctgtacaggacaatgaccctatcccctgggaacatgaagatcaagagacaggggaaggtgttaaatagatttaagtttcaaagcaaaacaaactgtgattattgtatttacttgtactgctgcttatcaatattgctgactttacaaactgatataattattaccattaggaattataaaaatatttcacaatctacactttccaaatgtgcaatgtggtaagtagagaaccatgttagaagtaataattgtttcagaattagaacttggcttcccaaacaatttaagtgttgtgtaaagatgttgctgtcaaagtgattagacagcctggctattctgtcatttgttcacagtggttttactgggtaccccctaggaccagccctgtagtggaccggctggagcctgcagtagaggttctgtcaaagctgagcccctttaccttcagtttcacccaggacctgctagtcctaattttacctactaaattgtatttcacataaccaaagctcaaaatctactttcacttgagatttttaacacattaatgataaattttaatgcgttcttcatttacttaataagtgttaatttacttgatgaaaagtccgtatcataatgttcatgactgaaggtcaaagaaaaagaaacagcaccttattccaattctggactcatttcaagccatggctggttctggccaagtttaaataaattcaaacttaaactaaagcctgcttcagtgaactttttaaagctacctgaatgagtcttcagtttctaagtctaagaattgtagcagctttccaatgacattcagtagtctgatatgggggaaaaaatacttaaaaaaatgtcctctcttcacttccaaaatgtgggaaagttatttttctataagcagaaatgtgttcctcctaatatctcctttctcccaagataaaccatggttaatgatataggtatagattactcctcaaatacaaatagaagatggagatggtgatctttcttgttaatggtactaaacttacccttactcagaacattgaacttgaaccctactcaacttttaaaatactataggctaagttataaaaataatctagcaacctgagaaagagattaatatcaaaaagagaaaattcaacaaaccaagacagaatttggttaagaatacaaaataaaaagcataagggcaatgcagaaagcagtaaaactgtgtacccagacatacggtaaaatctgagtaacaggcaataaccattcattttatagcaaggtaaaacatacccaataaaacatgattatgatatatttctgccccttttaagtataatgacattcacccatgattcttgattactttgttatggaactcgggtattttcactgaaagtttccctcagaatagaaatgcctttagggcaaaccaagccatggagaatctgaaatataaaggatatgttatggaaaaaaaaagattttgctttttgtctatgggtttccggattctttgctttttcataagtggtcatagtttgctttttaacacaggaggtagggctgtattctttttacatccttcattacaaattttatttgaagctcatgtattcaaataaagtaaaatttaacccaagaatccaaaatattgtcttgtgatatggtagttataaaaaggattatcattgtctgtgattatttgaataaataatttttatgttcattatatgtagtaaatttaggatgtaagcttccagggtttgacactttaaacttgtaaagaaataaaaataattacgctttacttccgata

SEQ ID NO: 135926 - DNA, 1429 bp, Homo sapiens
  Payload ID: 6575
  Gene Symbol: GPR152
  Gene Name: G protein-coupled receptor 152
  Uniprot ID: Q8TDT2
  ENST ID: ENST00000312457
  CDS Start-End: 6-1418
cccaaatggacactaccatggaagctgacctgggtgccactggccacaggccccgcacagagcttgatgatgaggactcctacccccaaggtggctgggacacggtcttcctggtggccctgctgctccttgggctgccagccaatgggttgatggcgtggctggccggctcccaggcccggcatggagctggcacgcgtctggcgctgctcctgctcagcctggccctctctgacttcttgttcctggcagcagcggccttccagatcctagagatccggcatgggggacactggccgctggggacagctgcctgccgcttctactacttcctatggggcgtgtcctactcctccggcctcttcctgctggccgccctcagcctcgaccgctgcctgctggcgctgtgcccacactggtaccctgggcaccgcccagtccgcctgcccctctgggtctgcgccggtgtctgggtgctggccacactcttcagcgtgccctggctggtcttccccgaggctgccgtctggtggtacgacctggtcatctgcctggacttctgggacagcgaggagctgtcgctgaggatgctggaggtcctggggggcttcctgcctttcctcctgctgctcgtctgccacgtgctcacccaggccacagcctgtcgcacctgccaccgccaacagcagcccgcagcctgccggggcttcgcccgtgtggccaggaccattctgtcagcctatgtggtcctgaggctgccctaccagctggcccagctgctctacctggccttcctgtgggacgtctactctggctacctgctctgggaggccctggtctactccgactacctgatcctactcaacagctgcctcagccccttcctctgcctcatggccagtgccgacctccggaccctgctgcgctccgtgctctcgtccttcgcggcagctctctgcgaggagcggccgggcagcttcacgcccactgagccacagacccagctagattctgagggtccaactctgccagagccgatggcagaggcccagtcacagatggatcctgtggcccagcctcaggtgaaccccacactccagccacgatcggatcccacagctcagccacagctgaaccctacggcccagccacagtcggatcccacagcccagccacagctgaacctcatggcccagccacagtcagattctgtggcccagccacaggcagacactaacgtccagacccctgcacctgctgccagttctgtgcccagtccctgtgatgaagcttccccaaccccatcctcgcatcctaccccaggggcccttgaggacccagccacacctcctgcctctgaaggagaaagccccagcagcaccccgccagaggcggccccgggcgcaggccccacgtgagggtccaggaa

SEQ ID NO: 135927 - DNA, 4082 bp, Homo sapiens
  Payload ID: 6576
  Gene Symbol: GPR153
  Gene Name: G protein-coupled receptor 153
  Uniprot ID: Q6NV75
  ENST ID: ENST00000377893
  CDS Start-End: 261-2090
ccgccgccagcatgccccggcccgcgggccgctccgccgccagccacccccgcggccctcggcggcctgcgctcggcccgggggcgcgggaaccgcagccggagccggaggcgggagcagcgagccggagccccgggcgctcgaatgcaggatgctcgtggtccccagcatccttgagccaccaggagtgagggctgctgctccctgagacctggctccaaggaggatgccacagccgcctgccagctccggtctgcaccatgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacactcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaactaccggctgagcaatgccaagaagcaggcggtgcacacagtcatgggtatctggatggtgtccttcatcctgtcggccctgcctgccgttggctggcacgacaccagcgagcgcttctacacccatggctgccgcttcatcgtggctgagatcggcctgggctttggcgtctgcttcctgctgctggtgggcggcagcgtggccatgggcgtgatctgcacagccatcgccctcttccagacgctggccgtgcaggtggggcgccaggccgaccgccgcgccttcaccgtgcccaccatcgtggtggaggacgcgcagggcaagcggcgctcctccatcgatggctcggagcccgccaaaacctctctgcagaccacgggcctcgtgaccaccatagtcttcatctacgactgcctcatgggcttccctgtgctggtggtgagcttcagcagcctgcgggccgacgcctcagcgccctggatggcactctgcgtgctgtggtgctccgtggcccaggccctgctgctgcctgtgttcctctgggcctgcgaccgctaccgggctgacctcaaagctgtccgggagaagtgcatggccctcatggccaacgacgaggagtcagacgatgagaccagcctggaaggtggcatctccccggacctggtgttggagcgctccctggactatggctatggaggtgattttgtggccctagataggatggccaagtatgagatctccgccctggaggggggcctgccccagctctacccactgcggcccttgcaggaggacaagatgcaatacctgcaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgagagcctgctgtcgctgcggccctcggccctggatagcggcccgcggggagcccgcgactcgccccccggcagcccgcgccgccgccccgggcccggcccccgctccgcctcggcctcgctgctgcccgacgccttcgccctgaccgccttcgagtgcgagccacaggccctgcgccgcccgcccgggcccttccccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttttcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgcacctggca

SEQ ID NO: 135928 - DNA, 3930 bp, Homo sapiens
  Payload ID: 6577
  Gene Symbol: GPR155
  Gene Name: G protein-coupled receptor 155
  Uniprot ID: Q7Z3F1
  ENST ID: ENST00000295500
  CDS Start-End: 346-2958
cccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcaggtactgtcctagatgttaaggacacaacattgagcaaaaacatgcatagtccctgcttccgtgacacttgagtgaactgaatgtgcaaagtccctgtggcacaaagtccctggggccagtgtgtgtggcgggtgtagaaggagctaaagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaa

SEQ ID NO: 135929 - DNA, 4876 bp, Homo sapiens
  Payload ID: 6577
  Gene Symbol: GPR155
  Gene Name: G protein-coupled receptor 155
  Uniprot ID: Q7Z3F1
  ENST ID: ENST00000392551
  CDS Start-End: 300-2912
gggggcggggcctcgcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagatgtgattataaagacttcagtggaataatcgcaagttcccatgtgagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcactatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatctctac

SEQ ID NO: 135930 - DNA, 6730 bp, Homo sapiens
  Payload ID: 6577
  Gene Symbol: GPR155
  Gene Name: G protein-coupled receptor 155
  Uniprot ID: Q7Z3F1
  ENST ID: ENST00000392552
  CDS Start-End: 240-2852
gcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcactatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatctctactaaaaaaaaaaaaaaaaaaaaaaattagccaggtgtggtggtgtgcacctgtaatcccagctacccaggaggctgaggcaggaaaattgcttgaaaccaggaggcagaggttgcagtgagctgagatcgtgccactgcactccagcctgagtgtcagagtgagactctgtctcagaaaaaaaaaaaaaaattctaaagattacatttagaatttagtctttttaaagtgtccatgtataaaaatatataatttttaaaattactaaatgttgccttttctcttagtctaatattttagctactaaaacaaaatataaactggatagcttataaacaacataaacttatttctcacagttttggaggctgtgaagtccaagattaaggcactaacagatctagtgtctggtaaggcaaatttctggctcatagatggtaccttcttgctgtgtccccacatggtagatgggaagaactggtctcattggccccttataaggacattaattccactcaataggctccaccctcatgatctaataacctctcaaaggccctacctcctaatactaacacattgaggatgtgacttcaactttacatttctacaggcagagaagtggggctgtgtaaattcttcccatcagtacttgaatgttcatttaacaaataacttatcgagcatctagcatgttccagacacaatctgaacactgagcacacaacagttggaacaaatatgattcctatcctcatggagcttctattctcctgtgaaaaacagatgttaaacatgattgaggattaggtttcaacataagaattctaggaggacacagacatttagaccatagcatcttcaggtaaactttatcttcagtaaattaaagagatctatttagatgacctttgagcatcttaattattagatgtcagtgctagtttaacttattttaaacgtttcagatatttatttaattatactttaagtgtctcatgtaaaaaagttatttataaaataatttatagggttagagtcattgcccttttaatgcaacaaataaacagttttttaaaaacctgcatgggggccaggcgcggtggttcatacctgcaatcccagcactttgggaggtcgaggctggcggatcacgaggtcaggagatcgagaccaccctgattaatgcggtgaaatcccgtctctactaaaaatacaaaaaattagccagacgtggtggtgggcacctatagtcccagctactcgggaggctgaggcaggagaatggcatgaacccggaaggcggagcttgcagtgaaccaagatcgcgccactgcactccagcctgggcgacagagtgagactccatcgcaaaaaaaaaaaaaaaaaaacctgcatggaagcctagtatatttattaataacaaataaattatactttagtgtactattaacctataccaattttaagttgtgattagggaatggggatgtttttaagctgaattgtcttgctgcggaactttccttttttaataagaccatattatgactctgaatgctcaagggtaagtctaaggcctcattgctgttaccaggagatttttctagttacagtaataaagatgttaattcacatgcatgcagacaactgaaactcaagtggagaatttgtttgtgaacaagtcatactacttctgttatttgcatgaatggaatctgcaatatctttttccatgggagaccctaaaagaaaaccctggatcagaatgatctgcagtttcagataataaaggcttttaagagacatttttagaattaaaaatatgctaattttattaaatgaaaatatttgtaactgttaactttctcactgacaaagcaagtttctcaataaaatacctattttaacttgca

SEQ ID NO: 135931 - DNA, 7321 bp, Homo sapiens
  Payload ID: 6577
  Gene Symbol: GPR155
  Gene Name: G protein-coupled receptor 155
  ENST ID: ENST00000614352
  CDS Start-End: 248-2776
ggggcctcgcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcactatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatctctactaaaaaaaaaaaaaaaaaaaaaaattagccaggtgtggtggtgtgcacctgtaatcccagctacccaggaggctgaggcaggaaaattgcttgaaaccaggaggcagaggttgcagtgagctgagatcgtgccactgcactccagcctgagtgtcagagtgagactctgtctcagaaaaaaaaaaaaaaattctaaagattacatttagaatttagtctttttaaagtgtccatgtataaaaatatataatttttaaaattactaaatgttgccttttctcttagtctaatattttagctactaaaacaaaatataaactggatagcttataaacaacataaacttatttctcacagttttggaggctgtgaagtccaagattaaggcactaacagatctagtgtctggtaaggcaaatttctggctcatagatggtaccttcttgctgtgtccccacatggtagatgggaagaactggtctcattggccccttataaggacattaattccactcaataggctccaccctcatgatctaataacctctcaaaggccctacctcctaatactaacacattgaggatgtgacttcaactttacatttctacaggcagagaagtggggctgtgtaaattcttcccatcagtacttgaatgttcatttaacaaataacttatcgagcatctagcatgttccagacacaatctgaacactgagcacacaacagttggaacaaatatgattcctatcctcatggagcttctattctcctgtgaaaaacagatgttaaacatgattgaggattaggtttcaacataagaattctaggaggacacagacatttagaccatagcatcttcaggtaaactttatcttcagtaaattaaagagatctatttagatgacctttgagcatcttaattattagatgtcagtgctagtttaacttattttaaacgtttcagatatttatttaattatactttaagtgtctcatgtaaaaaagttatttataaaataatttatagggttagagtcattgcccttttaatgcaacaaataaacagttttttaaaaacctgcatgggggccaggcgcggtggttcatacctgcaatcccagcactttgggaggtcgaggctggcggatcacgaggtcaggagatcgagaccaccctgattaatgcggtgaaatcccgtctctactaaaaatacaaaaaattagccagacgtggtggtgggcacctatagtcccagctactcgggaggctgaggcaggagaatggcatgaacccggaaggcggagcttgcagtgaaccaagatcgcgccactgcactccagcctgggcgacagagtgagactccatcgcaaaaaaaaaaaaaaaaaaacctgcatggaagcctagtatatttattaataacaaataaattatactttagtgtactattaacctataccaattttaagttgtgattagggaatggggatgtttttaagctgaattgtcttgctgcggaactttccttttttaataagaccatattatgactctgaatgctcaagggtaagtctaaggcctcattgctgttaccaggagatttttctagttacagtaataaagatgttaattcacatgcatgcagacaactgaaactcaagtggagaatttgtttgtgaacaagtcatactacttctgttatttgcatgaatggaatctgcaatatctttttccatgggagaccctaaaagaaaaccctggatcagaatgatctgcagtttcagataataaaggcttttaagagacatttttagaattaaaaatatgctaattttattaaatgaaaatatttgtaactgttaactttctcactgacaaagcaagtttctcaataaaatacctattttaacttgcattactgacatcttttctttgagtaatctgaataatgcagaagccatcatagaggtcttttctatacattctcaatgttttcttaaatgggtttcctgagttctgttcttcatgactctgggctctgcaaacagggtttcccaattacgcattctataaacacttttatgaatgagtcaatatgacattgagtccttttcatacatttcatcatttccaatatgtagagtgacagctagaaaaatgataaaattttgattaaaacctatctctttttcttcagcatagtcaattgttttcttaactctcaatgagtaactccatgcctagcttgtgcttagctttcaatatttttagactaagacaaagtgtatttggcattttgagaacaacaattaatggtcagtaaatttctaaagcaagaaaaatgtgaaactagtgttttatatgtttgttacgcagcagaatgcggctcttagtgtttgccccttcatatctcatcatgtaaaatattaaattactttaggccactgcacataggtagtcctgtcatgagtgatggctggagaaaagttcaggatcataaatgttatcatcattcttcaagaaaagatgagattataaatttctgcaattggtatgataaaaggttgaaataattaatgaaa

SEQ ID NO: 135932 - DNA, 4193 bp, Homo sapiens
  Payload ID: 6578
  Gene Symbol: GPR156
  Gene Name: G protein-coupled receptor 156
  Uniprot ID: Q8NFN8
  ENST ID: ENST00000315843
  CDS Start-End: 198-2642
ggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggg

SEQ ID NO: 135933 - DNA, 4154 bp, Homo sapiens
  Payload ID: 6578
  Gene Symbol: GPR156
  Gene Name: G protein-coupled receptor 156
  ENST ID: ENST00000495912
  CDS Start-End: 23-259
accaacaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 135934 - DNA, 4442 bp, Homo sapiens
  Payload ID: 6578
  Gene Symbol: GPR156
  Gene Name: G protein-coupled receptor 156
  Uniprot ID: Q8NFN8
  ENST ID: ENST00000464295
  CDS Start-End: 447-2891
ggggaccgtgggcgtcctgcacatagcagcgggcttggcgcttctcggcggtccgacgctgatgaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggg

SEQ ID NO: 135935 - DNA, 2525 bp, Homo sapiens
  Payload ID: 6578
  Gene Symbol: GPR156
  Gene Name: G protein-coupled receptor 156
  Uniprot ID: Q8NFN8
  ENST ID: ENST00000461057
  CDS Start-End: 19-2451
acaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagcca

SEQ ID NO: 135936 - DNA, 5265 bp, Homo sapiens
  Payload ID: 6579
  Gene Symbol: GPR157
  Gene Name: G protein-coupled receptor 157
  Uniprot ID: Q5UAW9
  ENST ID: ENST00000377411
  CDS Start-End: 144-1151
gggcgggggagcggccggacgcgggcggggcgggcgcctggacgcgagcctagggcgcctcggtgcccagacggcggcggcgtggccgcacgcgcggcccggcttctgtcctcgcggcgctccggctcctggccccccacgccatgcagccgtccccgccgcccaccgagctggtgccgtcggagcgcgccgtggtgctgctgtcgtgcgcactctccgcgctcggctcgggcctgctggtggccacgcacgccctgtggcccgacctgcgcagccgggcacggcgcctgctgctcttcctgtcgctggccgacctgctctcggccgcctcctacttctacggagtgctgcagaacttcgcgggcccgtcgtgggactgcgtgctgcagggcgcgctgtccaccttcgccaacaccagctccttcttctggaccgtggccattgcgctctacttgtacctcagcatcgtccgcgccgcgcgcgggcctcgcacagatcgcctgctttgggccttccatgtcgtcagctggggggtcccgttggtcatcactgtggcagccgtcgccctgaagaagattggctatgacgcctcggacgtgtctgtgggctggtgctggatcgacctggaggccaaggaccatgtcctgtggatgctgctgacggggaagctgtgggagatgctggcatatgtgctgctgcctctgctgtacctcctggtccggaagcacatcaacagagcgcacacggcactctctgagtaccggcccatcctctcccaggagcaccgcctgctgcgccactcctccatggcggacaagaagctggtgctcatcccgctcatcttcatcggcctcagggtctggagcaccgtgcggttcgtgctgaccctctgtggctccccggccgtgcagacgccggtgctggtggttctgcatggtatcgggaacacgtttcagggaggtgccaactgcatcatgttcgtcctctgcacccgcgccgtccgaactcggctcttctctctctgttgctgctgctgctcttctcagcctcccaccaagagcccggctggcactcccaaggctcccgcgccttccaagccaggagaatctcaggaatcccaagggaccccaggggaacttccaagcacctgagcttttgtcctttctagttctgtgcataggtgctgccttcctgggggtaggcacttctgtgagtccctgctgcaggggcagaagtgcatgtctgctgcaccagaagcccccgctattgatgctctcggctccattgggagagcagctgccaactcagcttcttctacctcctagatcctcaggcagcaagttccaccggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtcaggggccctcagagatgtgtccccatccacacatcatggagcagattcccggctggtcagggtgttaagattctctggagaacccggctttccttggagactttgctcaacagaggaaccagttgccattcaccaggttgaaggttcccctgaggttgcatggtgaccaccaggggcaagcacagcccggcgcagctgctcagggacagcagtctccccgggcctcctggcctctccctccatgggctgctaacccttgccgtagcttgggtttgagtgtcaagcacaggccagaatccacactcctgtccccacctgtcaatcacttcagacacaggttccctccttccaattccaaagctggaacaagggcaggaagaggcgtctcagggaacccccgaagaccccactgtctctccagctcctttcttagaatcctcctcttcttggggagaccaaaggggatgagtagggaggggttctggcttatttacttcttagtttagttttttgtaagtaaagtggccggagagatgagtaatccaaatacgattcctcaggccgggcacagtggctcacacctgtaaccctagcactttgggaggccaaggcaggcagatcacctgaggtcaggagttcaagaccagcctggccaacatggtgaaaccctgtctctactaaaaatacaaaaattagccaggcatggtgatgcacgtctgtaatcccaggtctttgggaggctgaggcaggagaatctcttgaacctgggaggcggaggttgcggtgagccaagaccacaccattgcactccagcctgggcaacaagagtgaaactcggtctcaaacaaacaaatacgatttcttcctaaaggtgaaggttttaagcttcagagtcagtttttttttttttttttttttaaaaaaggagcctcattctgtcgcccggagctgatgtggtggtgcgtgcctgtagtccctactactcaggaggctgagacgggaggatcccttgagcccagggatttgaggcttcattgaactgggatggcaccactgccactccagcctgggcaacagcaggaccctgtctcaaaaaaagaaaaaaacaaaggattcaaaaggattcagctgttttgtattcagctgaggtaagtggcggcatggagcatggagcgattatttacatttaaaagaaaagaattgaaagtaagcacctgtatctctatttttattctgtgggtcttccacaaacgctttcgtcttatttcagaaaacagcttctgtgttcagtcacaggagccatcggcaaagaatggaagtggaaatgctacctccagggtcttggtgagagaaagtacagctttacctgataggtgatttcccttggaatccatcagaactcgacaaagcatgattttctgagcctagtaaaatggttctgaatcaaaaccgaagtcacgctgtgctgccgatccctgtttgactctcaaaaccaaaatctgtatcaggaaaggaataatcatttagcagactgagtccaaaatgctcatttttggtttcctgtgaaaatggatttctttttgtcgctttctttttttttttttttttttttgagatggagtctcactctattgcccaggctggagtgcagtggtgcaattttgactcactgcaaccaccgcctcccaggttcaagcgattctcctgcttcccaatcccaagctgctgggattacaggcatgcgccaccatgctcggctaattttttgtattttcagtagagacgggttttcaccatgttggccaggctggtctcgaactcctgacctcaggtgatccacccacctcagcctcccaaaatgcttcgattgcaggcatgagccactgtgcctgtccaagaaaacagatttcttgatggaaattagtgagacagacatccccttaggattgaaagagagctctgggctgctccagggaaagccacttggcagaaatagcctctgtaagtgaattctggattcccctgaagacgttacagcaaatctctgggtatgtctctggtaaagaccctcacttgagcttctagaagggagcgaaaattcaggaatttgcttgctgcaaaagagaacatgattaacaggtaaaagagaaaagacaatataggccacagaggaatagtgttaggatcaaccctgctcagcaggggcctctggagccctccctgctgtacccaagccagagctgagacatggctccccagatggactggctgtggtcaggaaaggcctgtagagggagctgagggctcagaaaatacctgctccgggtgcctgggctcaagttctcattccatttctttgatgccactggccactgtatctgcttttgtaaaaacctccaaaaagttatacatcaggtatctctagtcagcttcctccgctgcccacctcttgccacagatgagtgatcactgtgaatggtggtgaccaggtgggcagggcaggggcttgtctaagtgccttagcccaggcccctggcccatcgacctcgaaaacagcaatatcgcctccttcttagatccagttaccaagtcagtctagctgggtgggtagtgctcagacagaaaggctggatgggaaggaagtcacatcctaaaagtccaggagggggccaggcgcagtggctcacgcctgtaatcccagcactttgggagaccaaggtgggcagatcacctgaggtcaggagtttgagaccagcctggccaacatggtgaaaccctgtttctactaaatatacaaaaaaaaaaaaaatagttggatgtggtttcgtgtgcctgtagtgccagctactcaggaggctgaggcaggagaattgcttgaacccagaaggcagaggttgcagtgagccgagactgcaccactgcactccagcctgggtgacagagcaagactccatctcaaaaaataaaacaagtccaggaggggctgttacttctttttagtttatttatttttgtgaggcagggttttgctgtctggagcatcatacccagtctggagtgcagtgatgcaatcatggctcactgcagcctccacctcccaggctcaagcgatcctcccacctcagctccctgagaagctgggaccacaggcctggctaaattttgactttttgtagagacaaggttttgccatgttgcccagtcagatctcaagcgaggggctgttacatctgatcagggcaaaaggggctgtgctccttggacactttgcacagccccagtgggcttctttctcctctgttagtgtggttaatgttcatctgcctgcatccctgagtcacccaagtgtaacctcagccataacacgtactgcagccggaacggtgtccgcagctcagcgtccctctcccatgcactttctgaactttggtcttttaaccaggtttaccagccgctttctgcctctttgtgcttttgagggttttttggtttgtttgttctgttttgtttttaaataaagatgattatttggcccaggctgagggtgcaaacagaactcttcacgtgtccacgacaagaaaaatagtttttacaaacttctagttgtggcatcaaaagtgtgagtttttgcacctgcaaaattgtaatgcaagccctgactgggtggaagctgaagtcttgctgttttaaattaaataaataaattatttttctccta

SEQ ID NO: 135937 - DNA, 198 bp, Homo sapiens
  Payload ID: 6579
  Gene Symbol: GPR157
  Gene Name: G protein-coupled receptor 157
  ENST ID: ENST00000465853
  CDS Start-End: 1-198
tgtggatgctgctgacggggaagctgtgggagatgctggcatatgtgctgctgcctctgctgtacctcctggtccggaagcacatcaacagagcgggtatcgggaacacgtttcagggaggtgccaactgcatcatgttcgtcctctgcacccgcgccgtccgaactcggctcttctctctctgttgctgctgctgct

SEQ ID NO: 135938 - DNA, 6959 bp, Homo sapiens
  Payload ID: 6580
  Gene Symbol: GPR158
  Gene Name: G protein-coupled receptor 158
  Uniprot ID: Q5T848
  ENST ID: ENST00000376351
  CDS Start-End: 360-4007
aatgagagcggcggtggcggcagccgggccgagagacggactcgggctgactccagccgctgggagcgcgaggccatgtaacccgctcggctccaggctgcgaggtgcgtaatccccagccggcccctcgcgcagcgggcacggccagcgctgccacaggtgacttgatttctgcgacggtagcttagccacccggggccaatctcgaaacattcttattttcaagtcctttggactgggtgccatctggagaagggggaagactcctcgaaaaagtctgactgttgagaaactgacgatccaaatttaaaaagtgattcccccccctcccgttccctcctcttctctctgggaggcagatgggagccatggcttaccccttactcctctgcctcctgcttgctcagctgggattgggagctgttggcgccagccgcgacccccaaggacggccggattcccctcgagagaggaccccgaaggggaagccgcacgcccagcagccgggtcgagcctctgcctcggactcctcggctccctggagccgctccaccgatggcaccatcttggcgcagaaactcgccgaggaggtgcccatggacgtggcctcttacctctacaccggggactcccaccagctgaagcgagccaactgctccggccgctacgagttggcgggcctgccggggaagtggccagccctggccagcgcgcacccctccttgcaccgggcgctggacacactgacacacgccaccaacttcctcaacgtgatgctgcagagcaataagtcgcgggagcagaacttgcaggacgacctggattggtaccaggcgctggtgtggagccttctggagggcgagcccagcatctcccgggcggccatcaccttcagcaccgattcgctgtccgcaccggccccacaggtcttcctccaggccacgcgcgaggagagccgcatcctgctccaagacctgtcctcctccgcaccccacctggccaacgccactctggagaccgagtggttccacggcctccggcgcaagtggaggccccacttacaccgccgcggccccaatcaggggccccggggcctgggccacagctggcggcgcaaggacgggctcggcggggacaagagccacttcaagtggtctccgccttatctggagtgcgagaacgggagttacaagcccgggtggctggttactctttcctctgccatctacgggttgcagcctaacctggtcccggaattcaggggtgtcatgaaagttgacataaatcttcagaaagtggacattgaccaatgctcaagtgatggctggttttcaggaactcataaatgccacctcaacaattcagagtgtatgccaattaaaggcctaggattcgttcttggagcctatgagtgcatttgcaaagcaggattctatcatcctggagtcttaccagtgaacaactttcggagaaggggtccggatcagcatatttcaggaagtacaaaagatgtgtcagaagaagcctatgtctgcctaccttgcagggagggctgccccttctgtgctgatgacagcccatgcttcgtccaggaagataagtatttacgacttgccatcatctccttccaagccctgtgtatgctgctcgacttcgttagcatgctggtggtctaccactttcgcaaagcaaagagcatccgggcatcgggccttatcctgttggaaacgatcctttttggatctctgctcctatactttccagttgttattttgtactttgagccaagcacatttcgctgtattctcctaagatgggctcgtcttctcggttttgctactgtttacggaactgtcactctcaaacttcacagggttttgaaggtgtttctttcacgaacggctcaacgaattccatatatgactggcggacgggtcatgaggatgctggcagtaatactcttggtagtgttttggtttctcattggctggacttcatctgtgtgccagaatttggagaaacagatttcacttattggccaggggaaaacatccgatcacctcatcttcaatatgtgcctcattgaccgctgggactacatgacagcagttgctgaatttttattcctcttgtggggtgtttatctctgctatgcagtgcggacagtcccatcggcattccatgagccccgctatatggctgttgcagttcacaatgagctcatcatctctgctatattccatacaattagatttgttcttgcctcaagacttcagtctgattggatgttgatgctgtattttgcacatactcatttgactgtgacagtcaccattgggttgcttttgattccaaagttttcacattcaagcaataacccacgagatgatattgctacagaagcatatgaggatgagctagacatgggccgatctggatcctacctgaacagcagtatcaattcagcctggagtgagcacagcttggatccagaggacattcgggacgagctgaaaaaactctatgcccaactggaaatatataaaagaaagaagatgatcacaaacaacccccacctccagaaaaagcggtgctcgaagaagggcctaggtcgttccatcatgagacgcattacggagatcccagagacagtcagccggcagtgctctaaagaggacaaggagggcgccgaccatggcacagccaaaggcactgccctcatcaggaagaaccccccagagtcttcagggaacacagggaaatccaaggaggagaccctgaaaaaccgagtcttctcactcaagaaatcccacagcacttatgaccacgtgagagaccaaacggaagagtccagtagcctacccacagaaagccaagaggaggagacaacagaaaattccacactggaatccctgtcgggtaaaaaactaacacaaaaactaaaagaagacagcgaggctgagtccacggagtcggtgccgttggtgtgcaagtcagcaagcgctcacaacctcagctcagagaagaaaactgggcacccacgaacatcgatgttacagaagtctctcagtgtcatagcaagcgccaaggagaagactcttggattagctgggaaaacccaaacagcaggtgtggaagaacgcactaaatcccagaaacctttgccaaaagataaagagacaaacagaaatcactcaaattctgataacacagagactaaagatcctgccccccaaaactcaaatcctgcggaggagccaagaaagcctcagaaatctgggattatgaaacaacaaagggtcaaccccaccactgccaattctgacctgaacccaggcaccacccagatgaaggacaactttgacattggggaggtgtgtccttgggaggtttatgacctgacccctggtcctgtgccttcagaatcaaaagttcaaaagcacgtatctattgtggcttctgaaatggagaaaaaccccactttttccttaaaggagaaatctcaccacaagcctaaggcagctgaggtttgtcagcaatccaatcagaagcgcatagataaggctgaagtatgcctttgggagagccaaggccagtccattttggaagatgagaagcttttgatttccaagactccagttctcccagagagggcaaaagaggagaacggaggtcagcctcgtgcagccaatgtgtgtgctgggcagagcgaagaactgccccccaaagctgtagcatcaaaaacagagaatgaaaatctcaaccaaataggacaccaggaaaaaaagacatcttcttctgaggagaatgtgcgtggctcctataactcaagtaataacttccagcaacctttaacatcacgagcagaggtttgtccttgggagtttgagaccccagctcaaccaaatgctggaagaagtgtagctttacctgcctcttctgctctaagtgcaaataagatagcagggcctaggaaagaagagatctgggatagttttaaagtgtagcatctccaggaagaagaggaaaaggagggaaccccggattggatatgagacagaagatataagaatcaaatattcccaaggaggatttgtcaatcaaggaaaacatgacagatggtgaggtaaagtcaaaggcatgggtagaagaggaccaggggggcaagagcaacaacgtcataatggagaagtcagactttggtcaagaaagtccttcccttggtaacactaggaaaatctttccatttcagcatgtttaaggaaaatagcccacaatgtctgccctgatcaatatgtatccatgggactttgaagatcctaagccaggtaaaccaggagacacagaagacgtaccagatttgcaaagaaagaaaaggtataagacatatataactgaaattctaagtagctgaccgagaagaacttactttacctatttaaccttgatagcactgctaacttaatgcatcccaaaaatatcttttatattaatgattgctctcattttcttataaatgtatgtttcagtatatcgttgtgtctcatattcaagcattccagattgtataatttttgcaaataactttggtattatgtgacacaacacatttatgcaatctgcagctattcaattgttattgcaccttacagaatacctgctatctatcaactttagttgattcttgaagtacagtaagctttctctggcttgggaagccataactgttactataaaaacttttagttttggctgtggtttatatattgtgactttgaatttgactctattatttcacatcatggtttgttatactgtcttaatcagggttttttatacaagttgagttacttgttttgcacttcttgttaggactcagaagctttattaatattggagatcaagtggtcctacttagtcatatgtctcaataagttaaggacaacttatccgttgtttattcaaagtcagagatagataacgccttcattccaattaattgtcccttttaactctttcagtatttcctacttagcagcatttccaaaggaagaagctaagagtgagaaaaatataccgtgcattattattactattggaaagggaagactctagggatgacataagaattatagcagtactataaacccaggaagtttgcctttcaaaaaaaaacacaggtagctcctgatagcactttcaagggattatttttttaaagagaaaaattatggtagcatcaagatcattgtatggatatatttttattatgtgtactgaaaatacagtattttaaaataccttaaagtatttattctcataaactcttattcattgcttcagctacaggtagaacttgctgggctcaaatcccaaagaggttttataaccttatttattcaaaacctataaggtggtatggaatcttcattctcccaagcactggaaaatgtctaagtcctgcaaattgccattgtgagccacttgctcgacatgtaacatgtaaggtccatttgcaaagcaaagcagcccccaaagcatattttataaagcttattgcattccacactgatctcttggcatgggaatcctaagctgccgactaagccctaccgacatgatcatgcagtgagattccaaagctcagtctcatttcatttaaagaagaatcactcagaaatagaaccgagacttccctttttctccctgtaaacacccaagtatcaactgcttatttggccaggacactcccagcacaaataactattttttatgtcacaagcagcaaggaggacatgctagggtgataaaagatggagaaacaggatcagagggtggatatagggctgttcttagagagtattttcagtggaaggtaaaaacagaattctccatattcatcatcaaatttttctcagtgatttttttattcaggagtaagcaagcacttcactgtttcacaaagctgtgcgcaaatcttcctcacccatttgctgactttatgcattactcaggttggtggggtcggtttgagaagatatagaaattctatttttgtgtctttacaccatttatttcttttatctcttccttttcaatgaaggcctatatgcttggtgacctcctttaaggaatctttgtgaactgggttggaagttcctagacccacatatttgtttcatttatgtctgaaatctgttagcacttgattcctttcttgagaattatgcagtcaagcatcagtgactttctattgcacttcaggattgatcctgctagagatgtgagttaaaaagacttgccaaattatatcttagcgacattctatagttcatagattattctccaccagcataaatcagtgagagtgcctagagtctttctgagagtttcattgccattatcaacaagagaagttgaaatttacaagtcaggaggttatttttccagattgataaccatagaaagtgaataaacacttttaaggtcgcaaacatttgctaggttgtccttctcaatgcatgtgcaggctgcatcctgtccttgtttttaagccagggtttataaataagtagatttataccaatcttaatagaattgtatattttatgcaagaattaaatgctttacaacatgaagtataactcaacccattgtaaactttggtggcaatatggatttgaaactcgacagttctcttgtatttgcttcctaggtttctgcatgcaagttatgacaggtaggactgaaaaaacactgccttttgacttctagcatttagcaaccgagagtcgtagagtcaataaagctgtaagtgtcttcacttaatctgtggttctcctaaaactattatctgaaacctacagcatcccaccatgaaatatttggtaaatttatgttgtgacgtgttgcagcatgtaaataattataacttctctgcaataaaacatatttatatg

SEQ ID NO: 135939 - DNA, 2039 bp, Homo sapiens
  Payload ID: 6581
  Gene Symbol: GPR160
  Gene Name: G protein-coupled receptor 160
  Uniprot ID: Q9UJ42
  ENST ID: ENST00000355897
  CDS Start-End: 609-1625
ccggcccttgtttcgttgggcccggacgggacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaagtaaaaa

SEQ ID NO: 135940 - DNA, 1299 bp, Homo sapiens
  Payload ID: 6581
  Gene Symbol: GPR160
  Gene Name: G protein-coupled receptor 160
  ENST ID: ENST00000492492
  CDS Start-End: 1201-1299
ctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccggcttgctccacttatcgggctcaccaaatacagctgcagtatgaattccatcttctacacaacagtaaaccagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtataggtaatcggtcagagtggtgggagaaactgttgggaaaggagcaggccttctgaaaggtcggaaggcttcaggggagaataagctgaacgcagctgttctctgaccttgaggcagagggcaaggagtaggtacaaggacgtgtaggagaatttatcttaaataggcttgttcacttgtgttgtccagaaacgacttttgatcatcagcgcgcatgactgctccctgaaaggaagaacaataatgttaattacccgcagactgtgtttgctccaggctttcggcattatgtctgtactgaataaaagcaagcagctccagctgttcgaggctgctctcttcttcagccattagtgccgggcagcccactagctgctgttacactgcatatctgtgtctgagtactcctttcttcagttgcttggccagggtctgtgggacagacccagcagctggtgccctgtgtgaggaacgctgcaatggatcgcgacggaaccctcgaaaacgaagagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatactt

SEQ ID NO: 135941 - DNA, 740 bp, Homo sapiens
  Payload ID: 6581
  Gene Symbol: GPR160
  Gene Name: G protein-coupled receptor 160
  ENST ID: ENST00000482710
  CDS Start-End: 476-740
ttatcgggctcaccaaatacagctgcagtatgaattccatcttctacacaacagtaaaccagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtatagagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggt

SEQ ID NO: 135942 - DNA, 731 bp, Homo sapiens
  Payload ID: 6581
  Gene Symbol: GPR160
  Gene Name: G protein-coupled receptor 160
  ENST ID: ENST00000485735
  CDS Start-End: 243-731
cagtggcttgggagctggagcaggtggtggaggcctgaaatgactacttgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagc

SEQ ID NO: 135943 - DNA, 783 bp, Homo sapiens
  Payload ID: 6581
  Gene Symbol: GPR160
  Gene Name: G protein-coupled receptor 160
  ENST ID: ENST00000473675
  CDS Start-End: 353-783
agagcttactcacatagcatattggtatatcaaaatgaaatgcaaggaaccaaaaataacataattgaaggcagtaaaagtgaaattaaataggaagatcatcagtcaaggaagacccactggagactgaaaccacctgttttcagagcttcaggaaaagacttaatctgaaggatcctgcagctaaaaagctttgaaaactgtgttaaggggccccataagcatcgcttctaaacttcactgacaaaagggactggggtcatgctgtctggagtcagagtgagggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaat

SEQ ID NO: 135944 - DNA, 7806 bp, Homo sapiens
  Payload ID: 6582
  Gene Symbol: GPR161
  Gene Name: G protein-coupled receptor 161
  ENST ID: ENST00000271357
  CDS Start-End: 178-1818
gactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 135945 - DNA, 2400 bp, Homo sapiens
  Payload ID: 6582
  Gene Symbol: GPR161
  Gene Name: G protein-coupled receptor 161
  Uniprot ID: Q8N6U8
  ENST ID: ENST00000367835
  CDS Start-End: 558-2147
gttttgtgatgactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaaggtgagcagcaaaggcgataccaggatcgtccacggcgggactggaggaggagaatgggactgtgcggagcctgcgggaagaatctgaaagtgtctgtgtgatggagagagacatggaaaaggcgacgtcccagcggctggaactggggcggaggaacgggaacagggaaggcctgagttaggcaccacaaaggttttcaggagaaaagtggggcgagccgagaggagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagc

SEQ ID NO: 135946 - DNA, 1983 bp, Homo sapiens
  Payload ID: 6582
  Gene Symbol: GPR161
  Gene Name: G protein-coupled receptor 161
  Uniprot ID: Q8N6U8
  ENST ID: ENST00000367836
  CDS Start-End: 528-1721
ggtgcgtgcccgggactctgccgatgcgggccgcgccccctggggccaagagactccacgtcccgctcagggcaaagggtgtggggagaagcggtcacgcccctcggctggaatccgtgaggaccaggtgagcagccttctcccagccgggactcagggcgctgtctccccgagcctgggcgggcggcgggtggcgcgcccagaagtggcccggcgccgccggatgggcggctctgcccctcagatctgcgggagggagattcggctggttcttggaaaggggagaactcgaccagccctcggcgccttctgggccaagcttaacccccgtgcaacctttggacaaaggcatatgggatgagaacgtctgttggcctggtgcactgtgcgtcctctgagaggtgaaggagcactgtgtggtcagagggctgcgagctctctgtttgggttccgaggaagacagaatgggctgaactggaactgacctaaatgtcagcaagaggagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaa

SEQ ID NO: 135947 - DNA, 2676 bp, Homo sapiens
  Payload ID: 6582
  Gene Symbol: GPR161
  Gene Name: G protein-coupled receptor 161
  Uniprot ID: Q8N6U8
  ENST ID: ENST00000367838
  CDS Start-End: 315-1904
gtaggtgcgtgcccgggactctgccgatgcgggccgcgccccctggggccaagagactccacgtcccgctcagggcaaagggtgtggggagaagcggtcacgcccctcggctggaatccgtgaggaccaggtctttttcagtgtgctcaatatggtcaccaagcctggaaacatagagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaa

SEQ ID NO: 135948 - DNA, 7655 bp, Homo sapiens
  Payload ID: 6582
  Gene Symbol: GPR161
  Gene Name: G protein-coupled receptor 161
  Uniprot ID: Q8N6U8
  ENST ID: ENST00000539777
  CDS Start-End: 312-1667
cccgggcggagagggcggtccggatggagccaggctaaactcattgtgcgaggctgagggctcagggcgcgggccgggaagggtccccgcccccacggcgctccctttctccccgcgcccctctcggaggtcagggctgtcctccgcccgcactgcgccttgctttggagagctggagctctttgtgggaagatgttgggggcgcgcccctcccctgcggcctggggcttctgagaggcccaccccattctgctgggtgcagcccgccccgtttctccggcgccgcccgaagcccctaaacagtccgctggatgggagggcgtaggtgcgtgcccgggactctgccgatgcgggccgcgccccctggggccaagagactccacgtcccgctcagggcaaagggtgtggggagaagcggtcacgcccctcggctggaatccgtgaggaccagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 135949 - DNA, 8256 bp, Homo sapiens
  Payload ID: 6582
  Gene Symbol: GPR161
  Gene Name: G protein-coupled receptor 161
  Uniprot ID: Q8N6U8
  ENST ID: ENST00000537209
  CDS Start-End: 619-2268
aggcaaagtggggagtgaggaagggaaaacaaacattctgagaaggaactgttccgtcccccgagctgacagcgcccgctctttgttttgtgatgactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaaggtgagcagcaaaggcgataccaggatcgtccacggcgggactggaggaggagaatgggactgtgcggagcctgcgggaagaatctgaaagtgtctgtgtgatggagagagacatggaaaaggcgacgtcccagcggctggaactggggcggaggaacgggaacagggaaggcctgagttaggcaccacaaaggttttcaggagaaaagtggggcgagccgagaggcctggtgcactgtgcgtcctctgagaggtgaaggagcactgtgtggtcagagggctgcgagctctctgtttgggttccgaggaagacagaatgggctgaactggaactgacctaaatgtcagcaagaggagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 135950 - DNA, 7388 bp, Homo sapiens
  Payload ID: 6582
  Gene Symbol: GPR161
  Gene Name: G protein-coupled receptor 161
  Uniprot ID: Q8N6U8
  ENST ID: ENST00000546300
  CDS Start-End: 153-1400
gactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 135951 - DNA, 2768 bp, Homo sapiens
  Payload ID: 6583
  Gene Symbol: GPR162
  Gene Name: G protein-coupled receptor 162
  Uniprot ID: Q16538
  ENST ID: ENST00000311268
  CDS Start-End: 788-2554
ttccttgcccctcctccccgagtcaccaccgtccagttccccaccctgcactcgtttcccgcccccccccgccccccacaaagctgtcctgccttccctctggcctgggctcactggcaggacgaccccgggagagagggtcctggagagtgagaggggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatgg

SEQ ID NO: 135952 - DNA, 1150 bp, Homo sapiens
  Payload ID: 6583
  Gene Symbol: GPR162
  Gene Name: G protein-coupled receptor 162
  ENST ID: ENST00000382315
  CDS Start-End: 79-933
ctccatggcagtgctgggcgcagccggagagaggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 135953 - DNA, 1610 bp, Homo sapiens
  Payload ID: 6583
  Gene Symbol: GPR162
  Gene Name: G protein-coupled receptor 162
  Uniprot ID: Q16538
  ENST ID: ENST00000428545
  CDS Start-End: 479-1393
cagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 135954 - DNA, 683 bp, Homo sapiens
  Payload ID: 6583
  Gene Symbol: GPR162
  Gene Name: G protein-coupled receptor 162
  ENST ID: ENST00000545321
  CDS Start-End: 1-683
ccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacagttgaagaagctggatctggcagctgcggcagcacacaccttctttgtagcaaaccccatgcacctgcagatgcgggaggacatggctaagtacagacgaatgtcgggagttcgg

SEQ ID NO: 135955 - DNA, 2062 bp, Homo sapiens
  Payload ID: 6584
  Gene Symbol: GPR17
  Gene Name: G protein-coupled receptor 17
  Uniprot ID: Q13304
  ENST ID: ENST00000272644
  CDS Start-End: 75-1178
ccgacacccacgggcggagatcacctgctgccccgcagacccctgtcccttcctcccggaccagcagctagaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 135956 - DNA, 1177 bp, Homo sapiens
  Payload ID: 6584
  Gene Symbol: GPR17
  Gene Name: G protein-coupled receptor 17
  Uniprot ID: Q13304
  ENST ID: ENST00000393018
  CDS Start-End: 74-1177
gagaaaatactcccagctggcctgatacccaggcacaggcttctcctaaacacaggtctccccacctgtcaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtga

SEQ ID NO: 135957 - DNA, 581 bp, Homo sapiens
  Payload ID: 6584
  Gene Symbol: GPR17
  Gene Name: G protein-coupled receptor 17
  ENST ID: ENST00000423019
  CDS Start-End: 172-581
gaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggctt

SEQ ID NO: 135958 - DNA, 2598 bp, Homo sapiens
  Payload ID: 6584
  Gene Symbol: GPR17
  Gene Name: G protein-coupled receptor 17
  Uniprot ID: Q13304
  ENST ID: ENST00000544369
  CDS Start-End: 612-1715
aaacgtcctgttgtgtccctcagctccagcccaagccccccacccagcccccgcctgctctgagtctctgagacagtcacacactcagactatgtggccaagctgggggcggggggcatgggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagact

SEQ ID NO: 135959 - DNA, 1786 bp, Homo sapiens
  Payload ID: 6585
  Gene Symbol: GPR171
  Gene Name: G protein-coupled receptor 171
  Uniprot ID: O14626
  ENST ID: ENST00000309180
  CDS Start-End: 232-1191
ggttgctactgctgcggctaaccaaacagctcatgcttctctgaagacttgcagcaaggcttgctgaggctcacagaagatagccccagtgttttggagtggttttgaatgtgattctgagatcagactgactgagctggaatcctggctttatatcttaccagctacacaaccttggagtcttagaaattttttcttttcaataagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagataaaaaaaaaaaaaacaaaaaaaaactcagtatgaaaaaatacagttagctagcaaatatggacaggtttacttagaaatcctgtttctaaatgcaagtcaagctttattgttaggcttgctgctactcattaacccaaatatttgtacaaaaaactaaagagtctcattgaacgaatgtaaaatcctgcaatatccttgaaatccaaaagaggtccatgacatagacccaaaggtattcatgagttattcatttaaatgcctggaactgacttcttgataaaaatataaaaaataatttccatgtaagttaccagaaagcccaccagcaacataattttaaagcctttcagattacttttaaaaaatgcagcttacatataacaacttgtgcctattttatttctaatctatcacttcaaaagatggtaatctttcaactcattattcctccaatttttaatgtcgaatttttttctaacacaataaccaaaagcttttatttataaaaaggcttgaaaaatata

SEQ ID NO: 135960 - DNA, 205 bp, Homo sapiens
  Payload ID: 6585
  Gene Symbol: GPR171
  Gene Name: G protein-coupled receptor 171
  ENST ID: ENST00000480322
  CDS Start-End: 152-205
ctgcaatggggttgctactgctgcggctaaccaaacagctcatgcttctctgaagacttgcagcaaggcttgctgaggctcacagaagatagccccagagtcttagaaattttttcttttcaataagcagtcatccttactttccctcaagatgacaaacagttcgttcttctgcccagtttataaagatctggagccattcacg

SEQ ID NO: 135961 - DNA, 960 bp, Homo sapiens
  Payload ID: 6585
  Gene Symbol: GPR171
  Gene Name: G protein-coupled receptor 171
  Uniprot ID: O14626
  ENST ID: ENST00000617554
  CDS Start-End: 1-960
atgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataa

SEQ ID NO: 135962 - DNA, 4485 bp, Homo sapiens
  Payload ID: 6586
  Gene Symbol: GPR173
  Gene Name: G protein-coupled receptor 173
  Uniprot ID: Q9NS66
  ENST ID: ENST00000332582
  CDS Start-End: 492-1613
accggcagccaggcaggcagacgggtagcaggggccagcactggcccccctcccagcttggcagtggcatgaagatgggagtgggagtgtatagtggaggaagcacctgccgggacccccacctgccagctagttggacaccccaaggctgtgtgctgcccacctggtgttccccaacacccccagccctacccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccctgcacaaggctccttactacttcctgctggacctgtgcctggccgatggcatacgctctgccgtctgcttcccctttgtgctggcttctgtgcgccacggctcttcatggaccttcagtgcactcagctgcaagattgtggcctttatggccgtgctcttttgcttccatgcggccttcatgctgttctgcatcagcgtcacccgctacatggccatcgcccaccaccgcttctacgccaagcgcatgacactctggacatgcgcggctgtcatctgcatggcctggaccctgtctgtggccatggccttcccacctgtctttgacgtgggcacctacaagtttattcgggaggaggaccagtgcatctttgagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctctctcagaagtgacaattcagaaaaagaaaagaacactgagaatgcaggtttttctactaacagctgaggagacaggctttcttactttaatgtctctccttctgacactgtccagaagggggaatttgtcctgtaaaatagacttccagagctcttttgccccctctgctcccatgcaccctccccttccaagtcctttagcaaggcctggatgtttagggagaaagtggtccaaggctgctgacaagagggaccaaagggggtgctgggttcccagggagcagggatgtttaattactatgtcatgtgcaatgttgttttaggccaacccttgccccaagcccagtctcttctccctccccaccatgtccagacctcccaaatggttcttgtgcatctgttggagaagtcaagggagtagggagaagggccccaaggatgggcccaggttaggtgaagagtaagatgtgagctgaactcctcgaactgaagagacccacacttggtcacattctctcacgctgccttcaggatccccagcccccaactcttcttcctgaggatggaaatccactccagccccactaggactgatgtgggtgccatacaggcaggagcagcccaccaggaaagtgtaaggagggagctgaactccccagagtagctggaccacagagacttgggtcagagctgatttcaaccccagaattgtctctcgggttcaccctactcttctgaagatgaaaatttgtttggggccttggtaaccgatagcggtacaaactccaaggcactgtggacttgagtccattcctatctgacctctttttgtccccctcaagcctcaggggcctcaagcccctccttagtagcccttggctgactgggccctgagccccaagcatccttctttcccaacaaccctccttccccatccttcccccacccttacctacacccaaagtggagcacactgcagtcagattctccaggagggagatccaagcctcctcccaggggtggagtccactctgggcttactttgaggcctgttctgtggattggtgagccaagctggcactccttgccctggtcttacccaggctctctgtccccctctcacttcctgtggggccggaatctgtatttatccatccccctttcccttctttatagaagtccctgtcctaaactccctccctagcccaagagagccccagaactggggaagcctgacccatacagaatggggagggcactctaggcaggagagacattaatgagcctggctgcagagtggccctggaaaggcaggccagagtggctgagaggctgggagtaggggagcctgttctctcagcgatagtgatgggggtgcctttccgagggggtggggtgggaagaccaagggggtggggggtagatagggtacatttaggagggttttcctccatttcttttttctaactgcctggattcaccattggattttgtaaatggaaaaactgaaatgaacaatgctatactggatgttttctctttctgactgtgtgtgtgtgtgtgcgtgcgtgcgtgcatgtgccctgtctgaccacatgtggagagacatgattgagtgatagtgtgtgtctgtgtgactttgtgtggggaggcactcctgaagaaaacttgcccggtgcacacacgtaaaatgcctgtatatggggacagatacagcacgtgcatgcatacacacacacacacacacaccacagttgagaggagacaaactagagtatgtgcccgtggtaggaagtcgagtggtcaagagatggatcttggaaactacataggtcggtagcaagagggtagactcccatctcacaagatgggcctcccttggcccaggccctgagcacgggagggctggggccgccagggaacttgaaaacctcatctcctcacaaagcctgtagccccatctcaaccccgtctcagtctccttcccaaactcaaacaaggtgttcctaaaattggaccaccatggagaatggggactgggaattgaggatcaaatgtgagggaaactgatgaggttaggaaatgccccccacaaagtaatggcttctggagggactgctcagtctgggatgggagcccttcctaggggccactgtatgcagctgggactttggtcagctttgaccaaatttagagggagggatgtcatggggaaaaaaaacccaagcccaggagtctacccagccagcctgctccctagacagttaatttactatctggttattctctcaggtgcacagaattgagttgaccatactcctcagttcttggcacactatatcatcattggtccatgtgaggcccttttatttttttttcttcagttttgtccccttcatcacccattcctgatcccatcctccccgccccctacacaggcacccactctcgtgtatttaacgtacgtccttccaatccaccgttcatgtgtttatttacatatatgtgtatctgtgaaaaatgtatggtattgctgtgtgttttaatttacataaacagtattgtactataaa

SEQ ID NO: 135963 - DNA, 579 bp, Homo sapiens
  Payload ID: 6586
  Gene Symbol: GPR173
  Gene Name: G protein-coupled receptor 173
  ENST ID: ENST00000375466
  CDS Start-End: 423-579
ccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaagatggagtttcgctcttgttgtccaggctggagtgcaatggcgcaatctcagctcaccacaacctccacctcccgggttcaagtgattctcctgcctcagcctccccagtagctgggattacaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccc

SEQ ID NO: 135964 - DNA, 1258 bp, Homo sapiens
  Payload ID: 6587
  Gene Symbol: GPR174
  Gene Name: G protein-coupled receptor 174
  Uniprot ID: Q9BXC1
  ENST ID: ENST00000276077
  CDS Start-End: 37-1038
caccattaggcaaagatagtttctctagagagaatcatgcctgctaattacacgtgtaccaggccagatggagacaatacagattttcgatactttatttatgcagtgacatacactgtcattcttgtgccaggtctcatagggaatatattagccctgtgggtattctatggttatatgaaagaaacaaaacgagctgtgatatttatgataaacttagccattgctgacttactacaagttctttccttgccactgaggatcttctactacttgaatcatgactggccatttgggcctggtctctgcatgttctgtttctacctgaagtatgtcaacatgtatgcaagcatctacttcttggtctgcatcagtgtgcgacgattttggtttctcatgtacccctttcgcttccatgactgcaaacagaaatatgacctgtacatcagcattgctggctggctgatcatctgccttgcctgtgtactctttccactcctcagaaccagtgatgatacctctggcaataggaccaaatgctttgtggatcttcctaccaggaatgtcaacctggcccagtccgttgttatgatgaccattggcgagttgattgggtttgtaactccgcttctgattgtcctatattgtacctggaagacggttttatcactgcaagataaatatcccatggcccaagatcttggagagaaacagaaagccttgaagatgattctaacctgtgcaggggtattcctaatttgctttgcaccttatcatttcagttttcctttagatttcctggtgaagtccaatgaaattaaaagctgcctagccagaagggtgattctaatatttcattctgtggcattgtgtcttgctagtctgaattcatgtcttgacccagtcatatactacttttccactaatgagttccgaagacggctttcaagacaagatttgcatgacagcatccaactccatgcaaaatcctttgtgagtaaccatacagcttccaccatgacacctgaattatgctaaaacaaaaaaccaaactgaatgtgacctgaaatgcaagtacatcagaacatatctgcaatacccaagccacagggaagaacttgcaaaacaacacagcttttcagttctgctctatcttactgctatggggaattcacttcttcaaagcaggacctatttggagcattacgatccacgattattgatgttgacatgtccatgtagtaatttttcttcaagt

SEQ ID NO: 135965 - DNA, 3844 bp, Homo sapiens
  Payload ID: 6588
  Gene Symbol: GPR176
  Gene Name: G protein-coupled receptor 176
  ENST ID: ENST00000299092
  CDS Start-End: 200-1744
ggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcgagtttggcaacatggaggtcactagaaaacttgataagagcagactgcctgggattaagttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggtgtcttacactgtttctctggaagccccagtcatatgactcactgtttctcctgatacccttcgtccctttcattgggatgtaggtaaggaatgacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaatctggttgggtatgtttcttatatatgtttgaagcagatggctgactactaacaggtcattgccaggtgtatttctatactctttgaagaataacattttaataaaaaa

SEQ ID NO: 135966 - DNA, 3681 bp, Homo sapiens
  Payload ID: 6588
  Gene Symbol: GPR176
  Gene Name: G protein-coupled receptor 176
  ENST ID: ENST00000543580
  CDS Start-End: 160-1572
cattctgatgcccgagtccaagtggcttttccagcgacacatctttggtctttgttctcagtgttgggggttgcgttgtgaggtgttgtctcttcatgagaaggcagtgtgacgtagtgatcacatcccaggctctggagttcaactgcttctgtctgaatgccagctccactgcttcttatttctagaactttgggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggtgtcttacactgtttctctggaagccccagtcatatgactcactgtttctcctgatacccttcgtccctttcattgggatgtaggtaaggaatgacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaatctggttgggtatgtttcttatatatgtttgaagcagatggctgactactaacaggtcattgccaggtgtatttctatactctttgaagaataacattttaataaaaaattgaaaagc

SEQ ID NO: 135967 - DNA, 2816 bp, Homo sapiens
  Payload ID: 6588
  Gene Symbol: GPR176
  Gene Name: G protein-coupled receptor 176
  Uniprot ID: Q14439
  ENST ID: ENST00000561100
  CDS Start-End: 867-2414
tgggggcgtcctccttcgtccccgcccggctgtcaagctgtgttctagcggccgagggaccgaggggggctaagaaagggggcgcccagccatgcagaggcaaaaaggcgctgcggaacggggtccccgtcgccagtgctgaggcaggaggtcggagccacaagtgaggggctgggaagcaggacccagcacgggcgtcttggcaggcggccgggcgcagggccaggctgctggggacgctcagggctttccacccaagccatgggcgctgtcgggcactcgggggtcccctcgtggctccggccactcggcgtgggcattacgttggcttcacatcgccatccagcctcgaagccaacaggactgaaaaatagcttcggccaaacgttctcctcccgctaaggagaggggtcgagtgcgtcagcccgaggggactggagagggatgccctagccctcgaggggcggaggacccgcggttgaaggaggcagcgggagcggagagcgccctccttgaccatcgaatgcctccttctgtgtttccattcctgtcgagtgggctgggccacgctgaccaccctggaggagggacggacgacgctcggcgggctctgaccgtgccgccttcttgtggctgctgactgggatccaggagggagtgggcatggggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattc

SEQ ID NO: 135968 - DNA, 7983 bp, Homo sapiens
  Payload ID: 6589
  Gene Symbol: GPR179
  Gene Name: G protein-coupled receptor 179
  ENST ID: ENST00000621958
  CDS Start-End: 22-7128
gtcctgagagctgccccaaggatgggcaccaggggagcggtcatgccccctcctatgtgggggctgctgggctgctgttttgtctgtgcctgggctctggggggtccacggcccatccgctctctgccccctctgtcttcccaagtcaagccaggatctgtacccatgcaggtgcccctagagggggccgaggccgccctcgcttatctctactctggagatgcccagcagctatcacaggtgaattgcagtgagcgctatgaagcgcgtggggcaggagccatgccagggctccccccaagcctacagggggcagcgggcacccttgcccaggccgccaattttctcaacatgctgctgcaagccaacgacatccgtgagtccagtgtggaggaggatgtggaatggtaccaggcactggtccgcagcgtggccgagggggacccaagagtgtacagggctttgctgacctttaaccctccaccaggggccagccacctacagctggccctgcaggccacccggactggggaggaaaccatcctgcaggacttgtctgggaactgggtgcaggaggagaaccctcctggggacctggacacccctgccctgaagaagcgagtgttgaccaatgacctagggagcctcggcagccccaagtggccgcaggcagatggatatgtgggggacacgcagcaggtgaggctgtctcctcctttcctggaatgccaggagggacggctccgacctggatggctgatcacactctctgccaccttctatggactcaagccagacctcagcccagaagtcagtagggggcaggtgcagatggacgtagatctccagagtgtggacatcaatcagtgtgcaagtggcccaggctggtactctaacacacacctgtgtgatctcaacagcacccagtgtgtccccctggagagtcagggctttgttcttggccgctacctctgccgctgccgacctggattctacggggcaagcccctctggggggttagaggagagtgacttccagactaccgggcaattcgggttcccagaaggcagatctgggagactgctgcagtgtctgccatgtcctgagggctgcaccagctgcatggatgccacaccgtgcctggtggaagaggccgcggtgctgcgggccgctgtgctggcctgccaggcctgctgcatgctggccatcttcctgagcatgctggtctcctaccgctgccgccggaacaagaggatctgggcatctggagtggtcctgctggaaactgtcctttttggattcctgctgctttactttcctgtcttcatcctatacttcaagcccagtgtattccgctgcatcgctcttcgctgggtgcggctgctgggttttgccatcgtctacggcaccatcatactcaagctttacagagtgctgcagctgtttctgtctcgaacggcccagcggagtgcccttctgagcagcgggcggctgctgcggcacctggggctgctcctgctacctgtgctgggcttcctggctgtgtggaccgtgggcgccctggagcgaggcatccagcacgcacctctggtgatccgaggccacactcccagtggccgccatttctacctctgtcaccacgaccgctgggactacatcatggttgtggctgagctgctgctgctgtgctggggcagcttcctctgctacgccacacgggctgtgctctcggccttccatgagccacgctacatgggcatcgccctgcacaatgagctactgctttccgctgccttccacacagccaggtttgtgctggttccctctctgcacccggactggaccctcctcctcttcttcttccacacccacagcacagtcaccaccacgctggctctgatcttcatccctaagttctggaagctgggggctcctccccgggaggagatggtggatgaggtgtgtgaggacgagctggacctgcagcactcaggctcctaccttggcagcagcatcgcctcagcctggagtgagcacagcctggaccctggagacattcgggacgagctgaagaagctctatgcccagctagaggtccacaaaaccaaggaaatggccgcaaacaacccccacctgcccaagaagcgaggcagctcatgccagggactgggccgctccttcatgaggtacctggcggaattccccgaggccctggccaggcagcactcccgggactcaggatccccaggccacggcagcctgcccggctcctcccgccgccggctcctcagctccagcctccaggaacccgaggggacaccagctctgcacaagtcccgcagcacctatgaccagcgcagggagcaggacccgcctcttcttgactcactgctgaggaggaagctggccaagaaggcctctcgaacagagagccgggagtcggtggaggggccccctgccctgggcttcaggtcagccagcgcccacaacctgacggtgggagagaggctacccagagcccggcccgcctctctgcagaagtcgctcagtgtggccagctccagggaaaaggccttgctcatggccagccaggcctacctggaggagacctaccggcaagcaaaggagcgggaggagcggaagaaggccaaggcagccatggccagcctggtgcggaggccatcagccaggaggctggagcggcctcgaggggcccccctgtcagctccaccttcccctgccaagagcagcagcgtggacagctctcacacctctgggaggcttcatgaggaggctaggagaaggctgcctcatccacccatcaggcaccaggtttctacccccatcttggccctgtctgggggcctgggagagccaaggatgctatctcccacctccaccttggctccagctctgctgccagctctagctccaaccccagcccctgccctggcaccagtcccagtatccccacaaagccccaacttactcacctacatctgcccctgggagaacgcagaactgccagccaagcaagaaaatgtgccccaggaaggcccctcagggccagagcgaggccaccactcccctgccccagctcgagccaggctctggagggccctctctgttgcagtagagaaaagcagggctggggagaatgagatggacgcagaggatgcacatcaccagagggaagctaatgatgtggacgaagacaggcccaagatcttccctaaatcccacagcctcaaggcccctgttcagcagggttccatgcgcagcctggggctggcgattaaagctctgacccgttctcggagcacctacagagagaaggagagtgtggaggagagtcccgaggggcagaacagcgggactgcgggagagagtatgggggcaccctcccgatcgcccaggctaggccggcccaaggcggtgagtaagcaggccgctcttatcccctccgatgacaaggagtccctccagaaccaacagaacgctcacaccagcaggatgctccaagtctgtcaacgggagggcagcagggaacaagaagacagaggcaggaggatgacccagggtctaggggaacggaaagctgagagagcaggtaaaacagggcttgccatgctgaggcaagtttccagggacaaaaacatcaagcaatcaaaagaaacccctgtcgggtggcaggaactgcccaaagctggcctccagtccctgggcagcgctgaccacagggtggcagaggtatgcccctgggaggtcactgaatcagaaacgcgtcagccagacagtggcaacaaggccgaaatctgcccctgggagacgagtgaaggagccccagagtcgagggcactaagacaagacccaggtgactcccaaaaaaagagaggggaggcccggggaaaatcagagcccatagatgtggttcccatgatgcggaaaaagccagagaggctggtgagggagcaggaagcagtgtgtccctgggagagtgccgatcgaggaggtctgtcccctgggtcagctcctcaggaccctggcagaatcagagacaaatctgaggcgggggacagtgtggaggccaggaaggtggagaagcctgggtgggaagctgctggcccagaagctcatacccctgacatcaccaaggcagagccgtgtccctgggaggcaagtgaaggaggcgaggatgggaaaccagcccaagaggcagtgaaggatctccctcaggaaaagcagaaaaccaggaaagcaaccttttggaaagaacagaaaccgggaggagacttggagtctctttgtccatgggagagtacagatttccggggcccctcagcagtctcaattcaggccccaggaagctcagagtgttcagggagtttgggcagtggcattgctgaagtgtgtctgtgggaggcaggagatgctcctgctatccagaaagcagagatctgtccctgggagctggatgataacgtgatggggcaggaaatgctgagtctggggacaggtagagaatctcttcaagaaaaggaaaaagcctccagaaaaggaagctttggagagatgggggaacaaactgtgaaagcagtgcagaaattaagtcaacagcaggagtcagtttgtcccagggagagcacggtccctgggcactccagcccatgtctagacaattcctcatccaaagctggtagccaattcctatgcaatggaggaagcagagcaacgcaggtgtgtccacaggaagatctcaggccggaggcacaggaagcaacacctgccaaaacagaaatctgtccctgggaggtaaatgaaagaacaagagaggaatggacatcagcacaggtgccaagaggaggagaatctcaaaaggacaaggagaaaatgcctggaaaatcggaaatcgaagatgtcacagcttgggaaaagcctgaggggcagatccaaaagcaagaagcggtcggcccctgggagagtgtggaccctggcagcttctccccacaaccacgtcctcaagacacagagagaccccaaacccttctccagatgtcaggcagtgtgggaagcaaagctgccgacatttgccctttggatgtggaggaaaacttgactgctgggaaggcagaaatctgtccctgggaggtgggtgctggagcaggggaggaaagggctttgggagctgaggccattaggaaatctccaaatgatacaggcaaggtttctgcagatcttggacccagggagagagctgttactgctccagagaagccacagaagccaaccccagagtgggaggtggcttgtccctgggggagtgtgggtccaggggcctgttctcagcatccaggtactctagatgctgatggaccaaaagctgggttccaggaactggatcatatgggctgcaggccaggtgaagtgtgtccctgggaagcacaggaagctgctaccagtgaaaaagccaagatctgtccctgggaggtaagtgaaggaactactgggaagggattggaccaaaaggcagggagtgaatcagcagagcagagggagaaagctctagaaaaggggagactcacttccctgggagaagacgtatcaaaagggatggcaaaactgtgtcaacaacaggaaactatttgtatttgggagaacaaggacttgagggaatcccctgctcaggcccccaagatctcagacttgcccagcagcatgagtagtgaagtggcagagggacattccttggaagcaacagagaagggggacctgagacaagacccaaagacaggttccttcccagaacacataacccaagaaaaagctccagctgcagacacagaagaattcactactgaagatggggaaaaaacaagccatgagctacaatccgtctgtccatgggagaccactgccccagcagattccgtctctcacctagacagacagcgccctgaccaacctaaagctagctcccagagactggtcagcactgggggcagggccgctgacgtgtgcccatgggatgttcctgatgcaggtgtgtataaatctgacagcagtgccaaggctgagacctgtccctgggaagtgactgaaagaatccctgtcaaaggggtgtcaaggcaggatggaaaaggggactctcaagaagagaaaggcagagccccagaaaaatcagagccaaaaggtgtgccagttcagaaaaagccagagatggcagacttcaggcagcaggaggctgtgtgtccctgggagagtcaagatggcaagggtctgtccccacagccagccccagatgcttctgacagaagcagaggcagttctgaggcagcaggcagtgtggagaccagggtagcggaagtgtgtctgtgggaagtggtagaggctccctctgccaagaaagcagagatctgcccttgggaggcgggtggaggagcagcagaggaaggggaacaggaaagagaatcacaagggcaaggagagatgttccttcagaaggcaggacctggagggacggaagaacacttctcaaaagcagcagcaaagcccagagagcaggaggcagtctgccctggggaaggcacaggctcaggagggctcttgccccagtcaggtgccctggacccagaactcaaagtcagccccaaggaagcaggcagcatgggaagcaggatggcagagctgtgccaatgggaaatcacagatccagaaggaaataaaataaagggtaccatggcagacatctgtcctggggaggaaactggagtcccatctgaggaatctggcctcctggctttaacagcaactcggagagaatttttccccacagctcctgaaaaaccactatgccttttagtccatgggcctctggatcacttctttccagaaagcaaaatcccctgccccaaggtaagcaggccagccagtactttcactctagaaggtgtcagagaactacaaggaccttcagggcttgagccaaggaccagcttagccccagagccaagtctccaggaagctgagtctcagtcttcgtccttaactgaagactcaggccaagtggcttttgaagctcagtatgaagaattcacccctcccactgtctatccttgggattgggagtaacagccttattaggtgaggtcaaacacagagctagctttcaggagccaaggccctttccaagtccaggtgttcccaaagagctgaatcaaagacagcttggccacttcccctccttgagaagaccagaagtcaacccatcccaaagacaaactgcatgaaaagggtacagcttagaccccaatgggaaggcccaccctctctttacttctaacttttcttcctgtttgaggaaacaaagactggacactctacttctaaggacgcctcccatccacctacagtactcacaacacaaaccacccgagtctggacactcacccacaaagccactgttagggatgaaaaaagtcagttgtgcccagcctaccttctctcacagggggacccaattctctgaagtctacgatggagcattttttgagaagaaactaaaccatacaaagtgttggcaacgtagggatggtggaccacagaaggctataaaggccaccatagaaagctgaagagccatttaattgaagcggaagataaattgggggaaaagctaaaatgactcaaaataggggcctgaaaatgctttaaggaccttgtcattttgactttgaatctcctgtttctgctttattgcttctcatacctgccctgcttgactgctgaagcagaaacaatcaggcacgctgacacccttatcagcatctggcatccaaagcaacatcagagagagagaacacagaagaaaagcaattgccccaggtcctccccacagtcaagggagctcttccttccagacatccttgtgtgcctcttgctagttttttagggggtctccccctcttcctgccctagctctcacca

SEQ ID NO: 135969 - DNA, 7980 bp, Homo sapiens
  Payload ID: 6589
  Gene Symbol: GPR179
  Gene Name: G protein-coupled receptor 179
  ENST ID: ENST00000616987
  CDS Start-End: 22-7125
gtcctgagagctgccccaaggatgggcaccaggggagcggtcatgccccctcctatgtgggggctgctgggctgctgttttgtctgtgcctgggctctggggggtccacggcccatccgctctctgccccctctgtcttcccaagtcaagccaggatctgtacccatgcaggtgcccctagagggggccgaggccgccctcgcttatctctactctggagatgcccagcagctatcacaggtgaattgcagtgagcgctatgaagcgcgtggggcaggagccatgccagggctccccccaagcctacagggggcagcgggcacccttgcccaggccgccaattttctcaacatgctgctgcaagccaacgacatccgtgagtccagtgtggaggaggatgtggaatggtaccaggcactggtccgcagcgtggccgagggggacccaagagtgtacagggctttgctgacctttaaccctccaccaggggccagccacctacagctggccctgcaggccacccggactggggaggaaaccatcctgcaggacttgtctgggaactgggtgcaggaggagaaccctcctggggacctggacacccctgccctgaagaagcgagtgttgaccaatgacctagggagcctcggcagccccaagtggccgcaggcagatggatatgtgggggacacgcagcaggtgaggctgtctcctcctttcctggaatgccaggagggacggctccgacctggatggctgatcacactctctgccaccttctatggactcaagccagacctcagcccagaagtcagggggcaggtgcagatggacgtagatctccagagtgtggacatcaatcagtgtgcaagtggcccaggctggtactctaacacacacctgtgtgatctcaacagcacccagtgtgtccccctggagagtcagggctttgttcttggccgctacctctgccgctgccgacctggattctacggggcaagcccctctggggggttagaggagagtgacttccagactaccgggcaattcgggttcccagaaggcagatctgggagactgctgcagtgtctgccatgtcctgagggctgcaccagctgcatggatgccacaccgtgcctggtggaagaggccgcggtgctgcgggccgctgtgctggcctgccaggcctgctgcatgctggccatcttcctgagcatgctggtctcctaccgctgccgccggaacaagaggatctgggcatctggagtggtcctgctggaaactgtcctttttggattcctgctgctttactttcctgtcttcatcctatacttcaagcccagtgtattccgctgcatcgctcttcgctgggtgcggctgctgggttttgccatcgtctacggcaccatcatactcaagctttacagagtgctgcagctgtttctgtctcgaacggcccagcggagtgcccttctgagcagcgggcggctgctgcggcacctggggctgctcctgctacctgtgctgggcttcctggctgtgtggaccgtgggcgccctggagcgaggcatccagcacgcacctctggtgatccgaggccacactcccagtggccgccatttctacctctgtcaccacgaccgctgggactacatcatggttgtggctgagctgctgctgctgtgctggggcagcttcctctgctacgccacacgggctgtgctctcggccttccatgagccacgctacatgggcatcgccctgcacaatgagctactgctttccgctgccttccacacagccaggtttgtgctggttccctctctgcacccggactggaccctcctcctcttcttcttccacacccacagcacagtcaccaccacgctggctctgatcttcatccctaagttctggaagctgggggctcctccccgggaggagatggtggatgaggtgtgtgaggacgagctggacctgcagcactcaggctcctaccttggcagcagcatcgcctcagcctggagtgagcacagcctggaccctggagacattcgggacgagctgaagaagctctatgcccagctagaggtccacaaaaccaaggaaatggccgcaaacaacccccacctgcccaagaagcgaggcagctcatgccagggactgggccgctccttcatgaggtacctggcggaattccccgaggccctggccaggcagcactcccgggactcaggatccccaggccacggcagcctgcccggctcctcccgccgccggctcctcagctccagcctccaggaacccgaggggacaccagctctgcacaagtcccgcagcacctatgaccagcgcagggagcaggacccgcctcttcttgactcactgctgaggaggaagctggccaagaaggcctctcgaacagagagccgggagtcggtggaggggccccctgccctgggcttcaggtcagccagcgcccacaacctgacggtgggagagaggctacccagagcccggcccgcctctctgcagaagtcgctcagtgtggccagctccagggaaaaggccttgctcatggccagccaggcctacctggaggagacctaccggcaagcaaaggagcgggaggagcggaagaaggccaaggcagccatggccagcctggtgcggaggccatcagccaggaggctggagcggcctcgaggggcccccctgtcagctccaccttcccctgccaagagcagcagcgtggacagctctcacacctctgggaggcttcatgaggaggctaggagaaggctgcctcatccacccatcaggcaccaggtttctacccccatcttggccctgtctgggggcctgggagagccaaggatgctatctcccacctccaccttggctccagctctgctgccagctctagctccaaccccagcccctgccctggcaccagtcccagtatccccacaaagccccaacttactcacctacatctgcccctgggagaacgcagaactgccagccaagcaagaaaatgtgccccaggaaggcccctcagggccagagcgaggccaccactcccctgccccagctcgagccaggctctggagggccctctctgttgcagtagagaaaagcagggctggggagaatgagatggacgcagaggatgcacatcaccagagggaagctaatgatgtggacgaagacaggcccaagatcttccctaaatcccacagcctcaaggcccctgttcagcagggttccatgcgcagcctggggctggcgattaaagctctgacccgttctcggagcacctacagagagaaggagagtgtggaggagagtcccgaggggcagaacagcgggactgcgggagagagtatgggggcaccctcccgatcgcccaggctaggccggcccaaggcggtgagtaagcaggccgctcttatcccctccgatgacaaggagtccctccagaaccaacagaacgctcacaccagcaggatgctccaagtctgtcaacgggagggcagcagggaacaagaagacagaggcaggaggatgacccagggtctaggggaacggaaagctgagagagcaggtaaaacagggcttgccatgctgaggcaagtttccagggacaaaaacatcaagcaatcaaaagaaacccctgtcgggtggcaggaactgcccaaagctggcctccagtccctgggcagcgctgaccacagggtggcagaggtatgcccctgggaggtcactgaatcagaaacgcgtcagccagacagtggcaacaaggccgaaatctgcccctgggagacgagtgaaggagccccagagtcgagggcactaagacaagacccaggtgactcccaaaaaaagagaggggaggcccggggaaaatcagagcccatagatgtggttcccatgatgcggaaaaagccagagaggctggtgagggagcaggaagcagtgtgtccctgggagagtgccgatcgaggaggtctgtcccctgggtcagctcctcaggaccctggcagaatcagagacaaatctgaggcgggggacagtgtggaggccaggaaggtggagaagcctgggtgggaagctgctggcccagaagctcatacccctgacatcaccaaggcagagccgtgtccctgggaggcaagtgaaggaggcgaggatgggaaaccagcccaagaggcagtgaaggatctccctcaggaaaagcagaaaaccaggaaagcaaccttttggaaagaacagaaaccgggaggagacttggagtctctttgtccatgggagagtacagatttccggggcccctcagcagtctcaattcaggccccaggaagctcagagtgttcagggagtttgggcagtggcattgctgaagtgtgtctgtgggaggcaggagatgctcctgctatccagaaagcagagatctgtccctgggagctggatgataacgtgatggggcaggaaatgctgagtctggggacaggtagagaatctcttcaagaaaaggaaaaagcctccagaaaaggaagctttggagagatgggggaacaaactgtgaaagcagtgcagaaattaagtcaacagcaggagtcagtttgtcccagggagagcacggtccctgggcactccagcccatgtctagacaattcctcatccaaagctggtagccaattcctatgcaatggaggaagcagagcaacgcaggtgtgtccacaggaagatctcaggccggaggcacaggaagcaacacctgccaaaacagaaatctgtccctgggaggtaaatgaaagaacaagagaggaatggacatcagcacaggtgccaagaggaggagaatctcaaaaggacaaggagaaaatgcctggaaaatcggaaatcgaagatgtcacagcttgggaaaagcctgaggggcagatccaaaagcaagaagcggtcggcccctgggagagtgtggaccctggcagcttctccccacaaccacgtcctcaagacacagagagaccccaaacccttctccagatgtcaggcagtgtgggaagcaaagctgccgacatttgccctttggatgtggaggaaaacttgactgctgggaaggcagaaatctgtccctgggaggtgggtgctggagcaggggaggaaagggctttgggagctgaggccattaggaaatctccaaatgatacaggcaaggtttctgcagatcttggacccagggagagagctgttactgctccagagaagccacagaagccaaccccagagtgggaggtggcttgtccctgggggagtgtgggtccaggggcctgttctcagcatccaggtactctagatgctgatggaccaaaagctgggttccaggaactggatcatatgggctgcaggccaggtgaagtgtgtccctgggaagcacaggaagctgctaccagtgaaaaagccaagatctgtccctgggaggtaagtgaaggaactactgggaagggattggaccaaaaggcagggagtgaatcagcagagcagagggagaaagctctagaaaaggggagactcacttccctgggagaagacgtatcaaaagggatggcaaaactgtgtcaacaacaggaaactatttgtatttgggagaacaaggacttgagggaatcccctgctcaggcccccaagatctcagacttgcccagcagcatgagtagtgaagtggcagagggacattccttggaagcaacagagaagggggacctgagacaagacccaaagacaggttccttcccagaacacataacccaagaaaaagctccagctgcagacacagaagaattcactactgaagatggggaaaaaacaagccatgagctacaatccgtctgtccatgggagaccactgccccagcagattccgtctctcacctagacagacagcgccctgaccaacctaaagctagctcccagagactggtcagcactgggggcagggccgctgacgtgtgcccatgggatgttcctgatgcaggtgtgtataaatctgacagcagtgccaaggctgagacctgtccctgggaagtgactgaaagaatccctgtcaaaggggtgtcaaggcaggatggaaaaggggactctcaagaagagaaaggcagagccccagaaaaatcagagccaaaaggtgtgccagttcagaaaaagccagagatggcagacttcaggcagcaggaggctgtgtgtccctgggagagtcaagatggcaagggtctgtccccacagccagccccagatgcttctgacagaagcagaggcagttctgaggcagcaggcagtgtggagaccagggtagcggaagtgtgtctgtgggaagtggtagaggctccctctgccaagaaagcagagatctgcccttgggaggcgggtggaggagcagcagaggaaggggaacaggaaagagaatcacaagggcaaggagagatgttccttcagaaggcaggacctggagggacggaagaacacttctcaaaagcagcagcaaagcccagagagcaggaggcagtctgccctggggaaggcacaggctcaggagggctcttgccccagtcaggtgccctggacccagaactcaaagtcagccccaaggaagcaggcagcatgggaagcaggatggcagagctgtgccaatgggaaatcacagatccagaaggaaataaaataaagggtaccatggcagacatctgtcctggggaggaaactggagtcccatctgaggaatctggcctcctggctttaacagcaactcggagagaatttttccccacagctcctgaaaaaccactatgccttttagtccatgggcctctggatcacttctttccagaaagcaaaatcccctgccccaaggtaagcaggccagccagtactttcactctagaaggtgtcagagaactacaaggaccttcagggcttgagccaaggaccagcttagccccagagccaagtctccaggaagctgagtctcagtcttcgtccttaactgaagactcaggccaagtggcttttgaagctcagtatgaagaattcacccctcccactgtctatccttgggattgggagtaacagccttattaggtgaggtcaaacacagagctagctttcaggagccaaggccctttccaagtccaggtgttcccaaagagctgaatcaaagacagcttggccacttcccctccttgagaagaccagaagtcaacccatcccaaagacaaactgcatgaaaagggtacagcttagaccccaatgggaaggcccaccctctctttacttctaacttttcttcctgtttgaggaaacaaagactggacactctacttctaaggacgcctcccatccacctacagtactcacaacacaaaccacccgagtctggacactcacccacaaagccactgttagggatgaaaaaagtcagttgtgcccagcctaccttctctcacagggggacccaattctctgaagtctacgatggagcattttttgagaagaaactaaaccatacaaagtgttggcaacgtagggatggtggaccacagaaggctataaaggccaccatagaaagctgaagagccatttaattgaagcggaagataaattgggggaaaagctaaaatgactcaaaataggggcctgaaaatgctttaaggaccttgtcattttgactttgaatctcctgtttctgctttattgcttctcatacctgccctgcttgactgctgaagcagaaacaatcaggcacgctgacacccttatcagcatctggcatccaaagcaacatcagagagagagaacacagaagaaaagcaattgccccaggtcctccccacagtcaagggagctcttccttccagacatccttgtgtgcctcttgctagttttttagggggtctccccctcttcctgccctagctctcacca

SEQ ID NO: 135970 - DNA, 7980 bp, Homo sapiens
  Payload ID: 6589
  Gene Symbol: GPR179
  Gene Name: G protein-coupled receptor 179
  Uniprot ID: Q6PRD1
  ENST ID: ENST00000610650
  CDS Start-End: 22-7125
gtcctgagagctgccccaaggatgggcaccaggggagcggtcatgccccctcctatgtgggggctgctgggctgctgttttgtctgtgcctgggctctggggggtccacggcccatccgctctctgccccctctgtcttcccaagtcaagccaggatctgtacccatgcaggtgcccctagagggggccgaggccgccctcgcttatctctactctggagatgcccagcagctatcacaggtgaattgcagtgagcgctatgaagcgcgtggggcaggagccatgccagggctccccccaagcctacagggggcagcgggcacccttgcccaggccgccaattttctcaacatgctgctgcaagccaacgacatccgtgagtccagtgtggaggaggatgtggaatggtaccaggcactggtccgcagcgtggccgagggggacccaagagtgtacagggctttgctgacctttaaccctccaccaggggccagccacctacagctggccctgcaggccacccggactggggaggaaaccatcctgcaggacttgtctgggaactgggtgcaggaggagaaccctcctggggacctggacacccctgccctgaagaagcgagtgttgaccaatgacctagggagcctcggcagccccaagtggccgcaggcagatggatatgtgggggacacgcagcaggtgaggctgtctcctcctttcctggaatgccaggagggacggctccgacctggatggctgatcacactctctgccaccttctatggactcaagccagacctcagcccagaagtcagggggcaggtgcagatggacgtagatctccagagtgtggacatcaatcagtgtgcaagtggcccaggctggtactctaacacacacctgtgtgatctcaacagcacccagtgtgttcccctggagagtcagggctttgttcttggccgctacctctgccgctgccgacctggattctacggggcaagcccctctggggggttagaggagagtgacttccagactaccgggcaattcgggttcccagaaggcagatctgggagactgctgcagtgtctgccatgtcctgagggctgcaccagctgcatggatgccacaccgtgcctggtggaagaggccgcggtgctgcgggccgctgtgctggcctgccaggcctgctgcatgctggccatcttcctgagcatgctggtctcctaccgctgccgccggaacaagaggatctgggcatctggagtggtcctgctggaaactgtcctttttggattcctgctgctttactttcctgtcttcatcctatacttcaagcccagtgtattccgctgcatcgctcttcgctgggtgcggctgctgggttttgccatcgtctacggcaccatcatactcaagctttacagagtgctgcagctgtttctgtctcgaacggcccagcggagtgcccttctgagcagcgggcggctgctgcggcgcctggggctgctcctgctacctgtgctgggcttcctggctgtgtggaccgtgggcgccctggagcgaggcatccagcacgcacctctggtgatccgaggccacactcccagtggccgccatttctacctctgtcaccacgaccgctgggactacatcatggttgtggctgagctgctgctgctgtgctggggcagcttcctctgctacgccacacgggctgtgctctcggccttccatgagccacgctacatgggcatcgccctgcacaatgagctactgctttccgctgccttccacacagccaggtttgtgctggttccctctctgcacccggactggaccctcctcctcttcttcttccacacccacagcacagtcaccaccacgctggctctgatcttcatccctaagttctggaagctgggggctcctccccgggaggagatggtggatgaggtgtgtgaggacgagctggacctgcagcactcaggctcctaccttggcagcagcatcgcctcagcctggagtgagcacagcctggaccctggagacattcgggacgagctgaagaagctctatgcccagctagaggtccacaaaaccaaggaaatggccgcaaacaacccccacctgcccaagaagcgaggcagctcatgccagggactgggccgctccttcatgaggtacctggcggaattccccgaggccctggccaggcagcactcccgggactcaggatccccaggccacggcagcctgcccggctcctcccgccgccggctcctcagctccagcctccaggaacccgaggggacaccagctctgcacaagtcccgcagcacctatgaccagcgcagggagcaggacccgcctcttcttgactcactgctgaggaggaagctggccaagaaggcctctcgaacagagagccgggagtcggtggaggggccccctgccctgggcttcaggtcagccagcgcccacaacctgacggtgggagagaggctacccagagcccggcccgcctctctgcagaagtcgctcagtgtggccagctccagggaaaaggccttgctcatggccagccaggcctacctggaggagacctaccggcaagcaaaggagcgggaggagcggaagaaggccaaggcagccatggccagcctggtgcggaggccatcagccaggaggctggagcggcctcgaggggcccccctgtcagctccaccttcccctgccaagagcagcagcgtggacagctctcacacctctgggaggcttcatgaggaggctaggagaaggctgcctcatccacccatcaggcaccaggtttctacccccatcttggccctgtctgggggcctgggagagccaaggatgctatctcccacctccaccttggctccagctctgctgccagctctagctccaaccccagcccctgccctggcaccagtcccagtatccccacaaagccccaacttactcacctacatctgcccctgggagaacgcagaactgccagccaagcaagaaaatgtgccccaggaaggcccctcagggccagagcgaggccaccactcccctgccccagctcgagccaggctctggagggccctctctgttgcagtagagaaaagcagggctggggagaatgagatggacgcagaggatgcacatcaccagagggaagctaatgatgtggacgaagacaggcccaagatcttccctaaatcccacagcctcaaggcccctgttcagcagggttccatgcgcagcctggggctggcgattaaagctctgacccgttctcggagcacctacagagagaaggagagtgtggaggagagtcccgaggggcagaacagcgggactgcgggagagagtatgggggcaccctcccgatcgcccaggctaggccggcccaaggcggtgagtaagcaggccgctcttatcccctccgatgacaaggagtccctccagaaccaacagaacgctcacaccagcaggatgctccaagtctgtcaacgggagggcagcagggaacaagaagacagaggcaggaggatgacccagggtctaggggaacggaaagctgagagagcaggtaaaacagggcttgccatgctgaggcaagtttccagggacaaaaacatcaagcaatcaaaagaaacccctgtcgggtggcaggaactgcccaaagctggcctccagtccctcggcagcgctgaccacagggtggcagaggtatgcccctgggaggtcactgaatcagaaacgcgtcagccagacagtggcaacaaggccgaaatctgcccctgggagacgagtgaaggagccccagagtcgagggcactaagacaagacccaggtgactcccaaaaaaagagaggggaggcccggggaaaatcagagcccatagatgtggttcccatgatgcggaaaaagccagagaggctggtgagggagcaggaagcagtgtgtccctgggagagtgccgatcgaggaggtctgtcccctgggtcagctcctcaggaccctggcagaatcagagacaaatctgaggcgggggacagtgtggaggccaggaaggtggagaagcctgggtgggaagctgctggcccagaagctcatacccctgacatcaccaaggcagagccgtgtccctgggaggcaagtgaaggaggcgaggatgggaaaccagcccaagaggcagtgaaggatctccctcaggaaaagcagaaaaccaggaaagcaaccttttggaaagaacagaaaccgggaggagacttggagtctctttgtccatgggagagtacagatttccggggcccctcagcagtctcaattcaggccccaggaagctcagagtgttcagggagtttgggcagtggcattgctgaagtgtgtctgtgggaggcaggagatgctcctgctatccagaaagcagagatctgtccctgggagctggatgataacgtgatggggcaggaaatgctgagtctggggacaggtagagaatctcttcaagaaaaggaaaaagcctccagaaaaggaagctttggagagatgggggaacaaactgtgaaagcagtgcagaaattaagtcaacagcaggagtcagtttgtcccagggagagcacggtccctgggcactccagcccatgtctagacaattcctcatccaaagctggtagccaattcctatgcaatggaggaagcagagcaacgcaggtgtgtccacaggaagatctcaggccggaggcacaggaagcaacacctgccaaaacagaaatctgtccctgggaggtaaatgaaagaacaagagaggaatggacatcagcacaggtgccaagaggaggagaatctcaaaaggacaaggagaaaatgcctggaaaatcggaaatcgaagatgtcacagcttgggaaaagcctgaggggcagatccaaaagcaagaagcggtcggcccctgggagagtgtggaccctggcagcttctccccacaaccacgtcctcaagacacagagagaccccaaacccttctccagatgtcaggcagtgtgggaagcaaagctgccgacatttgccctttggatgtggaggaaaacttgactgctgggaaggcagaaatctgtccctgggaggtgggtgctggagcaggggaggaaagggctttgggagctgaggccattaggaaatctccaaatgatacaggcaaggtttctgcagatcttggacccagggagagagctgttactgctccagagaagccacagaagccaaccccagagtgggaggtggcttgtccctgggggagtgtgggtccaggggcctgttctcagcatccaggtactctagatgctgatggaccaaaagctgggttccaggaactggatcatatgggctgcaggccaggtgaagtgtgtccctgggaagcacaggaagctgctaccagtgaaaaagccaagatctgtccctgggaggtaagtgaaggaactactgggaagggattggaccaaaaggcagggagtgaatcagcagagcagagggagaaagctctagaaaaggggagactcacttccctgggagaagacgtatcaaaagggatggcaaaactgtgtcaacaacaggaaactatttgtatttgggagaacaaggacttgagggaatcccctgctcaggcccccaagatctcagacttgcccagcagcatgagtagtgaagtggcagagggacattccttggaagcaacagagaagggggacctgagacaagacccaaagacaggttccttcccagaacacataacccaagaaaaagctccagctgcagacacagaagaattcactactgaagatggggaaaaaacaagccatgagctacaatccgtctgtccatgggagaccactgccccagcagattccgtctctcacctagacagacagcgccctgaccaacctaaagctagctcccagagactggtcagcactgggggcagggccgctgacgtgtgcccatgggatgttcctgatgcaggtgtgtataaatctgacagcagtgccaaggctgagacctgtccctgggaagtgactgaaagaatccctgtcaaaggggtgtcaaggcaggatggaaaaggggactctcaagaagagaaaggcagagccccagaaaaatcagagccaaaaggtgtgccagttcagaaaaagccagagatggcagacttcaggcagcaggaggctgtgtgtccctgggagagtcaagatggcaagggtctgtccccacagccagccccagatgcttctgacagaagcagaggcagttctgaggcagcaggcagtgtggagaccagggtagcggaagtgtgtctgtgggaagtggtagaggctccctctgccaagaaagcagagatctgcccttgggaggcgggtggaggagcagcagaggaaggggaacaggaaagagaatcacaagggcaaggagagatgttccttcagaaggcaggacctggagggacggaagaacacttctcaaaagcagcagcaaagcccagagagcaggaggcagtctgccctggggaaggcacaggctcaggagggctcttgccccagtcaggtgccctggacccagaactcaaagtcagccccaaggaagcaggcagcatgggaagcaggatggcagagctgtgccaatgggaaatcacagatccagaaggaaataaaataaagggtaccatggcagacatctgtcctggggaggaaactggagtcccatctgaggaatctggcctcctggctttaacagcaactcggagagaatttttccccacagctcctgaaaaaccactatgccttttagtccatgggcctctggatcacttctttccagaaagcaaaatcccctgccccaaggtaagcaggccagccagtactttcactctagaaggtgtcagagaactacaaggaccttcagggcttgagccaaggaccagcttagccccagagccaagtctccaggaagctgagtctcagtcttcgtccttaactgaagactcaggccaagtggcttttgaagctcagtatgaagaattcacccctcccactgtctatccttgggattgggagtaacagccttattaggtgaggtcaaacacagagctagctttcaggagccaaggccctttccaagtccaggtgttcccaaagagctgaatcaaagacagcttggccacttcccctccttgagaagaccagaagtcaacccatcccaaagacaaactgcatgaaaagggtacagcttagaccccaatgggaaggcccaccctctctttacttctaacttttcttcctgtttgaggaaacaaagactggacactctacttctaaggacgcctcccatccacctacagtactcacaacacaaaccacccgagtctggacactcacccacaaagccactgttagggatgaaaaaagtcagttgtgcccagcctaccttctctcacagggggacccaattctctgaagtctacgatggagcattttttgagaagaaactaaaccatacaaagtgttggcaacgtagggatggtggaccacagaaggctataaaggccaccatagaaagctgaagagccatttaattgaagcggaagataaattgggggaaaagctaaaatgactcaaaataggggcctgaaaatgctttaaggaccttgtcattttgactttgaatctcctgtttctgctttattgcttctcatacctgccctgcttgactgctgaagcagaaacaatcaggcacgctgacacccttatcagcatctggcatccaaagcaacatcagagagagagaacacagaagaaaagcaattgccccaggtcctccccacagtcaagggagctcttccttccagacatccttgtgtgcctcttgctagttttttagggggtctccccctcttcctgccctagctctcacca

SEQ ID NO: 135971 - DNA, 1698 bp, Homo sapiens
  Payload ID: 6590
  Gene Symbol: GPR18
  Gene Name: G protein-coupled receptor 18
  Uniprot ID: Q14330
  ENST ID: ENST00000340807
  CDS Start-End: 558-1553
agtaaaatgtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaaaaaccacatccagggtaaagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaa

SEQ ID NO: 135972 - DNA, 1468 bp, Homo sapiens
  Payload ID: 6590
  Gene Symbol: GPR18
  Gene Name: G protein-coupled receptor 18
  Uniprot ID: Q14330
  ENST ID: ENST00000397470
  CDS Start-End: 310-1305
aagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaacatttttgtgaattattc

SEQ ID NO: 135973 - DNA, 1660 bp, Homo sapiens
  Payload ID: 6590
  Gene Symbol: GPR18
  Gene Name: G protein-coupled receptor 18
  Uniprot ID: Q14330
  ENST ID: ENST00000397473
  CDS Start-End: 502-1497
aagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcaacctatgataatttaaagagaacataagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaacatttttgtgaattattc

SEQ ID NO: 135974 - DNA, 741 bp, Homo sapiens
  Payload ID: 6590
  Gene Symbol: GPR18
  Gene Name: G protein-coupled receptor 18
  ENST ID: ENST00000416594
  CDS Start-End: 448-741
cagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcaacctatgataatttaaagagaacataagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttgga

SEQ ID NO: 135975 - DNA, 8822 bp, Homo sapiens
  Payload ID: 6591
  Gene Symbol: GPR180
  Gene Name: G protein-coupled receptor 180
  Uniprot ID: Q86V85
  ENST ID: ENST00000376958
  CDS Start-End: 26-1348
cgtcggtgcagacctggagacgggcatgggggggctgcggctgctggctgtggccctcacgtgctgctggtggccgcagggcagccagggtaagaccctgcggggcagcttcagcagcaccgcggcccaggacgcccagggccagcgcatcggccacttcgagttccatggtgaccatgctcttctgtgtgtcagaatcaacaacatagcagtagctgttggaaaagaagctaaactctacctgttccaagcccaggaatggctaaagctacagcaaagcagtcatggttatagctgtagtgaaaaattatccaaagctcagttgacaatgaccatgaaccagaccgaacataatctgacagtgtcccagattccgtctccacaaacgtggcatgtgttttatgcagacaagtatacatgccaagatgacaaggagaattctcaggtggaagatatcccatttgaaatggtgttactaaacccagatgccgaagggaatccatttgatcattttagtgctggagaatctgggttacatgagttctttttcctcctagtcctagtgtactttgtgattgcttgcatttatgctcaatcattgtggcaggctattaagaaaggcggacccatgcacatgattttaaaggttctgacaactgcattgctgttacaagctggttcagctttagctaattacattcatttctccagttactccaaagatggaataggggtaccatttatgggaagtttggcagaattttttgacatcgcttcccaaattcagatgttatacttacttttgagtctatgcatgggttggacaatagtcagaatgaagaagtctcaaagcagacctctccagtgggattctacgcctgcatccactggcattgcagtattcattgtcatgacacagagtgttttgctactttgggaacagtttgaagatatcagtcatcatagctaccattcacaccacaacttagcagggatcctcctaattgttctaagaatttgcctagcattgtcattaggctgtggactctatcagatcatcacagtggagagaagtacactcaaaagggagttctacatcacatttgccaaaggctgtatcttgtggtttttatgccatccagttcttgcatgcatttctgtcatttttagcgactaccaaagagacaaggttattacaataggtgttatcctttgccagtctgtttccatggttattctctacagactctttctgtctcacagtctatactgggaagtttcttcactttcttcagtaacactaccactgaccatatcatctggacacaaaagtcgccctcatttctgatacttgatttttgttgagaggaaaagtgaattggttaaaagagtgcaataaggatccaaatacagtgacttttttttcatacatttagtatgaaaacttgaacagcgaaagcagagcatgttatttatataactgcatttaagcagtaccaagactgaaaaaaaaggtaataaatgaaatgttttgaaatatacttaaacaacaaactttgaagaaagtgttgttataaaattattgaagcgatttctatgtggaaataaatgtgaaaaataactatgatattttggtaaaatattcaccacttataatgcctcatcttaatagctaactcaggtttaatagtcttataaaaagtaatcagttaaatgattacttgcttataaatatctaaactagtccagttatgaaatcagtgtaatacattgatttttaaaactgctgctttttatgctttaaggaaaatgtatttcatatttgagtttaaaggaattgaaattacttcaggaaatgaatataaaataggttcacagttaaatgaataagcttttgtttatttgtgggtggagttattctccaattttttctgccatttttggctctagttcaggttttagcttgattagcaaaggtttttgacaaacagtttatgaaaaaataaaacttaaatacattacacgggttgtaaggacaaaggattttaaaatctgagcacttaggtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcaggattaaattttctatgaataattgaaaaacaaaacactcactggatttgttataatccgtgttggcactggattctaagtagttgccatcttgaatcctttgtaataaagccatacttttgtgtgtgtgtgtgatgccccagtattgagtatgctagctaaaaaatatcaagtgcctgattaaagaattgctaaatggttgtcaatactcgctgtataaaatgagtattcccattaatagtcactgattggaaattattctgttgctgtttgtcaagctgttcaggccttttcctttttacttctggcttattttaaaaatattttttatctatttactgtgtgtttaagcaagcaacagtgcactgatctggtagttaaattttttaattaaatagttaaaataatgtagtgcaacttaaaaatatctatggctttgtttttgtttttcttttgtacctagtctcattggaaatgactagtattctgcctcattttcagggcagaatatgtgtttgtgacccaaaatgacaaagttaccaagttcaacctgctcattaaatcatctctctattagttctttgtaaatcacttagtacattagagctacaggttaagactagaaagtctgagttatgttttaggtatacatgatcgtctgagtggtcataaccttttcttttatcatgtctcgctaataaccccagctattgtctgttgtgttcagctgagatgcaaaaaagaaattaagcaaaaaagaaaaagatgaagacttttcatgaattttgtgaacttgccaaaaggggaagggaaaaatctttgtgttacttcactcaaagaacataagtaactgcaattaacatatatgaaatttattactctgcttgcatttatgaaactaaccagttttttaaactttaattcttaaatttatggttggaaatgctgataatttattttgttatttaagagctgttgttaagtggaggaaagtagttgttaataaatgtataaaactgttcttgactagtaatcagggacaaaatttatagttcataagtcatgacacagtattcgctctttttctgaatgtttacatagagattcatcactgcagattacagaaagttaagtgtatactacaaactctaattaaagataaaaatcttttctacttttctttgtcagataatgcttttttatgtgtttttacattttttgaaagaagataaatggttcatccagagctttattaagaagcatttcttttcttcccttaaaaaatagatgcttatttttattgacatgtgtataataagatgggtgcctactgtgatgcattttaccaggcattttaccttcattattactcatctctattgtgataaccaggctcccatttaactgagtataagagagaataaatgatttctctaaggtcatcaaactatttagtttttccactttaccttcatgatttaaggaacatgtattagctgtgttttagtgagaatgaattgctatccatcataatttttgctgttgatttgaacattaaaactggaattgtgctaaaatcagaacatgcgcttgaatatctgtaagacctcagcacacttcagtatttgaacctggcttttaaccagacagtattactagcaggagagttaatctaggcagaagagcttgctttagggtaattatttattatctccagtaaagtcacatctgatgaacataggagatacacaaatctgagatcatctctaaaataatgagactagaacctatctatcaacatgaacatgggctccttcagcatgtttcttctaggagactgcacgttctttggaatttggaaatttggaattatctgtgaaacattttcttaaatagcttctgtggtatcaaatcattgaggttgttttttgtttgttttgagaattgatatgattgttagaagtagccagatacgaagaggtaatactgttttttattccaacatgtatttgtgaattgagactaaaataatgagattggttttcctctgtgatctgaaagtagtgtggtagaagcaccgtagcttgatttcttgcaatagctctctaagtaatattaccatgtccacacttgggcagccttctgcacagctccaggggcatcatatgtgttgtgctgtaggagtgccatgaagcctggaggtgaggaaagaagtgatcctgcccactagggccattctccacagtgtagccaaaacaatctcttaaaaatggaaatcatctggatgatgagcatacagaaattctttgtgctaatcttgtaatttttttgtaagtttgaaattatttcaaaaagtttaaaaatcatataaatcagatcaaactactacttccctgacaaaaaccctccatgtgcctctcattgcacttaggaaaagaagtcctcactcattactatgttctgcaaggcccatatgatctggttatctcttaatttgtaccactctctcacacacatatcccagcctcattgtccttcatcaaaaaaagatctagcttatatcacaccctcagatacttggcactagccatcttctctgcctgggacattctcttccaaatcttagcatggttggaaggctgaatcctcatccttcaggttctcagctgagatgtcttttagagaactcaccatctgtggtggatttatatggtgcagtttagtcaacctggagataggttctgcagaattctcttccatgcataatttcaggacaatgtaggccataagaaatgtttgatacaagatatagaaggcagaagtaaagtagcagccagatctgcattctttttgtaagaggaagggccagacaaggcacaaggcacaaggcactgttgcagcttatccacattattgcttatctgttggcttctcttggcctgtgggacaacagccaggcccacaggaacaccagttcctgccggaatggctccttcagcttctctggctcctgggccaggtgtgcgttttactctgacaaagggtgccagcttctgctggacaactccatcattcacactggaggattagaggcagggagagacctgtatggcttccagtccatcctcacaagttccactcagttcccacaggttctactcatcctagcaagttccttgcttcccccatttcccatgtcttccctttccaactgccagacacaaaagaaaccgcctcctataatccctataataagccccttattttgaatattaagatatgtgtatgtgtattagatcctagtggttcttttctgatcagaccctgattaaccataccatcctacctaatgctattcccccatcctagttctatcatattatccctttttttgtttgttgtacttagctggtttatctttgtcatctctcaaattagaatataaattttaagtgagtttgtctctattgttcattgctgtatgcctaatactaggacactccctggtgcatactagatgctcaaaaatatttttgagtgaatgaaggcaatgctgaaaaagttccaaatctgtacttaacagtgtagtattaattatgtaatagaagtacccgtagtgacttcaataataccttgcctattctttgttcaattgcatggaacttggtagtgtgtaaaaatcttgactagtcaagtagttgtcataaaacatcagttacgagaggatttctcaaattctcacagaggcagtttctctttattttatgtagtcctgtaataggaccatgtgtctggtttctggcctgccacaaccagaagcaccaatttaaaagagaagtttctagtcagctagaggagggaatgttgacagtagtcagaagcagctgggaaaagatgggaaaactagaaatgacaataacactcaaattgcagcagcctggggtcatttagtgtaggtgaaagcagccctgtgttgtgtatctcagtagactcttaagagatttgttgttcaatgtattcatgacagtgactgatggtaatcaagaaaatattaagttataagttatgttcagtagcctcaaagaagtatgcgaaaaccttctaatgttttcttcttgttaaacaggtaatatatgcacattgtacaaaaatcagaaagttgaaaaaggtggggaaaagaagtccttctctcactcatttcccttccctgaatccaaactctgttaccagttatctttctagaaatggccccatgcacatataaacatatatgaaacacaaattatagcataacatacagacttttgcacattcagcaatttattctgtagccttacctagaattgtcccatttttttcaccaattgcatagaactccattatatggatgtattttgattttttcaaagaatcagttctgttactgcacgttgttggttttcagtcttgctaatacagacaaggctgaaattaagacagtaatcaagaatttgccaagacttccttccctcctcccaaaatgcctccactccaggttccaggtctagatccttgggattttctaggtgatggaagtatctttgttattcatagtgagctctgatagttacgctaaccagatgactcaaataggggctagccacaccagaagaccaaccattggattagagggttggagttttgagtcatatgatattagcccaacctctgaggtggagagaggggttagagatggagttcagctttatatagagattgagtcaattaatcatgcctgtcatgaaaccccgagagaaactctggtcagtgatgctcaagtgaacttccctggttggcaatactctggtgtgttctaggagggtgacatgtccctgagggcacagaaactttgtgtttgggatcctcttacaccttgctctatgtatgtcttcttttggctgttctgatttgtatccttttgctataataaactgtaatagtacgcatagcactttgctgagttctgtgagttgttctatttaattatagaacctgaaggtattgtggggacccctgaacttgcagccagttggtcagaagtaaggatggtcctgggaatgcccaaagttgctagtttctgaagtgagggcagtcatatggaggactgggcccttaatctgtgaagtttggcttaacttcaggcagttggtgtcagaagccattgcaaatatcctgatgatccgtgcaaaacaaaaacacttaacagaaaattacgttgtactctctgtacggataattttcggttaagtgtttttgttttccatggattgtactagatatcaatctgataaataacttttattcattatagttttaatttgcatttctcttattaatttttgttttaaaaccattttctttccagttctacgatctgttaacatatttttcccacttttctattgggttggttgtctttttcttattgatttgttaaaactctttataacagaaattggtcatttgtgatatgagtctgaactgtgtttctcaatttgtgatttttctctttacttttttaatggtgtctttttcttgtagtttttttaatgcaggtggaattatcagtctttcatttttttcttctgtgttctacctgtttcacaggtagaaaagccttagctctttgagattatgtttaaatgccctgtattttcatctagtggttttatggttttattttgtatgtttttttcatccacctggaatttattttgctgttaaaatatgaattagagatccaacttaatttttttcagatggttgttgacttattgcaatatcatgtgttatataatccatctttactgattcgttgctaattggtttctggacttttaaggctatctgatgaactgttgatctggtaccacactgtttcaattattgtagtcttaaaattgctgtacgctttggtagggataattttctgttaagtgtttttgttttttataattttccaattagtcttgctcattttttatataaactttgaaatcaatttttctgattttcaaaagaaaaaaaatcctgtttagtattcttagtggaatgaattaaatttccatagcaatttagggaaatttgactttcttaacgtgttgagtgttaaacccacaggtggtagcatgacattgactcctcagccaagcatattatcaactgtcggaaactaggttttcccatagtgatccaagaaactagtacgaaatgcctttctgattttttaaaacttgtatacatatatagtacatattatatatacttatatattaagtaatcagaagtatgtgtttctcaatcaccttttaaagacttctttatatagctcttgtacatttcttgatatgaatatgttaatgttttctttcattatgttgcatatggcttttgttttctgcatgaaaactattgatttctgcattctaattttgttcccagtcacctaactgaattcttctaacagttgtaataaatttctggttggctctcttgtg

SEQ ID NO: 135976 - DNA, 3451 bp, Homo sapiens
  Payload ID: 6592
  Gene Symbol: GPR182
  Gene Name: G protein-coupled receptor 182
  Uniprot ID: O15218
  ENST ID: ENST00000300098
  CDS Start-End: 220-1434
gattgggggaatgcaggaaaaaccccatccctccctacagagcctcagcagtgacagctacttcccggatgagaagggcggccgtgaagccagcagggaagccagccccacagccaagggccccccagcctcctcacagctccccatagcctggacctgccggccctccctccaggaccgaggggctcccaagggaaactcaggcgtgtgctggtcccaatgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcctgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtagaggccagactcctccaacagtgaaggaaaaggcacaggtgagagtataggtgggagatttggggggatgtagaggggagggtcaaagcactcgtggtcaattttgaatctatcttaaaatactgaggtgtggagagagagacaggatcaggagcgatagagagcaggccctcagtgttgtactatttgtctcggtccttgtgtctaaggagcaatgcagaaaaaaaggtgaaataaatggaagagatagccatggactctggatcttttaaaaatctgcacttccagctgggattgggaagggagctgaggctaaagaggtgctcggcagaggaaactagacacattcatttcataaatcactctggctggaaacagtgaactctgcaggaacctcacaaaactccttttgcgtttgtgagcttgttgatcttccagctcactatgcaggttatggggacaagaggccagaggccaaggaaccaggcggccccagcaggacgttccctagctgtgcatcctatgcacagccatgataagtgaaggcggatggggatggcaggggtgggggcgaagccaaggtctgagacctgcaccctgcagctgggtcagcaggatggtatctccacccgcggccatccaggaaacacagctccatttccttgctgacaccctcccctccccgttgtccatcctgctccctccccacaagcaagaggagttgtcccagagtcagctcctcatagctgacctcttaccagcttcggatctaggaaacttccagacttctagggagacacagagctaccagaaagcccaacccacccccatctctttctctccagatcataggaaagtatcaagggatgtcattccgggagcagcccttgggacagccagcagcaggtgctggcagatgctctgtccttcaccctctgtccccggcaccagatggggaaggccacagtggaaacttctcaattccgtcacagggcagagctctgacactgttataagtcagttctccctggccatgtcttttcctaattttcctgtcccacaacttaggttccttaacacttgttctacagatgaaacaaaaaagtcctctgttaacaagtagaccttctggaaaaggatcacttatgtttgggagactaggaccctgtccatgaagaactctgaagtaaaggcctaagaacaggatctagtttccgccttccaattccacgtcctttgcctcttaatcctgcccgtggtaaggggactggatggaatcactgatagcctcttcaccatctcctctgtcctgcttaagtgctccatgtgtctggaatgtttaacttggagtaactactcactgacttggagaccacctgttctactttgagaaatcagaactgttctgtggatgcactgacagcgtgctccaactgcatatgcacccaggtttgtcaggagcatggaaggaaacctgcatctccctgtttactgggcccaaacctgaaagggtcttaagctgcagacagcttctcagtagcacagagctgaaggctttttgaaccaggagtctgggttgtggcttgggtcgcagtaagggcttagcctatcaatgcagaattcacattgaaaaagactttcctctcttgtcccaacacaaaaaagcaagccaagatctgatgcccatatcactgcctcctctgacttgggctacaggagtttcctgaaggaaaccaaattttacatctctgtcacattccagatcaccttagaggccacgctcccaagattagttatcaccctggcagtatgaatacttccctaaggcctcccatccatggaggggaagagtgggaaccagctgttacactcagcatctactgagcactgatgggagccctgcctgggccatgtgctgtggggccaaatggacatcactccctaacttcttgaggtctgtctcctctgtggattcacgcatgtatcaacctcattaaactatgccaaactttt

SEQ ID NO: 135977 - DNA, 591 bp, Homo sapiens
  Payload ID: 6592
  Gene Symbol: GPR182
  Gene Name: G protein-coupled receptor 182
  ENST ID: ENST00000622922
  CDS Start-End: 1-591
atgataagtgaaggcggatggggatggcaggggtgggggcgaagccaaggtctgagacctgcaccctgcagctgggtcagcaggatggtatctccacccgcggccatccaggaaacacagctccatttccttgctgacaccctcccctccccgttgtccatcctgctccctccccacaagcaagaggagttgtcccagagtcagctcctcatagctgacctcttaccagcttcggatctaggaaacttccagacttctagggagacacagagctaccagaaagcccaacccacccccatctctttctctccagatcataggaaagtatcaagggatgtcattccgggagcagcccttgggacagccagcagcaggtgctggcagatgctctgtccttcaccctctgtccccggcaccagatggggaaggccacagtggaaacttctcaattccgtcacagggcagagctctgacactgttataagtcagttctccctggccatgtcttttcctaattttcctgtcccacaacttaggttccttaacacttgttctacagatgaaacaaaaaagtcctctgttaacaagtag

SEQ ID NO: 135978 - DNA, 459 bp, Homo sapiens
  Payload ID: 6592
  Gene Symbol: GPR182
  Gene Name: G protein-coupled receptor 182
  ENST ID: ENST00000556850
  CDS Start-End: 1-166
ctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtagaggccagactcctccaacagtgaaggaaaaggcacagatcaccttagaggccacgctcccaagattagttatcaccctggcagtatgaatacttccctaaggcctcccatccatggaggggaagagtgggaaccagctgttacactcagcatctactgagcactgatgggagccctgcctgggccatgtgctgtggggccaaatggacatcactccctaacttcttgaggtctgtctcctctgtggattcacgcatgtatcaacctcattaaactatgccaaactttt

SEQ ID NO: 135979 - DNA, 1700 bp, Homo sapiens
  Payload ID: 6593
  Gene Symbol: GPR183
  Gene Name: G protein-coupled receptor 183
  Uniprot ID: P32249
  ENST ID: ENST00000376414
  CDS Start-End: 85-1170
aaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccaccgctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcactttcccatctccaactcggaagtaagcccaagagaacaacataaagcaaacaacataaagcacaataaaaatgcaaataaatatttcatttttatttgtaaacgaatacaccaaaaggaggcgctcttaataactcccaatgtaaaaagttttgttttaataaaaaatttaattattatttcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcaaagttatgagt

SEQ ID NO: 135980 - DNA, 1743 bp, Homo sapiens
  Payload ID: 6594
  Gene Symbol: GPR19
  Gene Name: G protein-coupled receptor 19
  Uniprot ID: Q15760
  ENST ID: ENST00000332427
  CDS Start-End: 356-1603
ctttccgcctagtgagaggcggtccgatttggcccttggggagtgtccgtcgcgttgatctgatggattcacgtacacaacaccacattctatgagattttgcaggcaaaagtccacaagctcgatatatgggacacctgcaccggcattggatttggccccgcaacatcttaaaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtgggtctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgta

SEQ ID NO: 135981 - DNA, 1751 bp, Homo sapiens
  Payload ID: 6594
  Gene Symbol: GPR19
  Gene Name: G protein-coupled receptor 19
  Uniprot ID: Q15760
  ENST ID: ENST00000540510
  CDS Start-End: 194-1441
tgtctccctaacaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtgggtctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgtagtttttgtgggttttattttacttgctttttatgttttaggaaaagcgttcactttgaactttagccaacagtccttttactattaatatattagttacatgcataaaaaagaaaatgctttcttactatttactgttggttcaaaaacataaacctaagccatacacac

SEQ ID NO: 135982 - DNA, 553 bp, Homo sapiens
  Payload ID: 6594
  Gene Symbol: GPR19
  Gene Name: G protein-coupled receptor 19
  ENST ID: ENST00000540796
  CDS Start-End: 376-553
agcgcgcaaaagtttcaaaactttccgcctagtgagaggcggtccgatttggcccttggggagtgtccgtcgcgttgatctgatggattcacgtacacaacaccacattctatgagattttgcaggcaaaagtccacaagctcgatatatgggacacctgcaccggcattggatttggccccgcaacatcttaaaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgc

SEQ ID NO: 135983 - DNA, 1515 bp, Homo sapiens
  Payload ID: 6595
  Gene Symbol: GPR20
  Gene Name: G protein-coupled receptor 20
  Uniprot ID: Q99678
  ENST ID: ENST00000377741
  CDS Start-End: 92-1168
aggtccgggctgcatgcagagctgagagctgaggactcccatctccagcctgcccgggtgaagcgcggcctggggtgtgctggctgccgtcatgccctctgtgtctccagcggggccctcggccggggcagtccccaatgccaccgcagtgacaacagtgcggaccaatgccagcgggctggaggtgcccctgttccacctgtttgcccggctggacgaggagctgcatggcaccttcccaggcctgtggctggcgctgatggcggtgcacggagccatcttcctggcagggctggtgctcaacgggctggcgctgtacgtcttctgctgccgcacccgggccaagacaccctcagtcatctacaccatcaacctggtggtgaccgatctactggtagggctgtccctgcccacgcgcttcgctgtgtactacggcgccaggggctgcctgcgctgtgccttcccgcacgtcctcggttacttcctcaacatgcactgctccatcctcttcctcacctgcatctgcgtggaccgctacctggccatcgtgcggcccgaaggctcccgccgctgccgccagcctgcctgtgccagggccgtgtgcgccttcgtgtggctggccgccggtgccgtcaccctgtcggtgctgggcgtgacaggcagccggccctgctgccgtgtctttgcgctgactgtcctggagttcctgctgcccctgctggtcatcagcgtgtttaccggccgcatcatgtgtgcactgtcgcggccgggtctgctccaccagggtcgccagcgccgcgtgcgggccatgcagctcctgctcacggtgctcatcatctttctcgtctgcttcacgcccttccacgcccgccaagtggccgtggcgctgtggcccgacatgccacaccacacgagcctcgtggtctaccacgtggccgtgaccctcagcagcctcaacagctgcatggaccccatcgtctactgcttcgtcaccagtggcttccaggccaccgtccgaggcctcttcggccagcacggagagcgtgagcccagcagcggtgacgtggtcagcatgcacaggagctccaagggctcaggccgtcatcacatcctcagtgccggccctcacgccctcacccaggccctggctaatgggcccgaggcttagtcagcagggctctgccaggggccgaaggtcaggactcatctgggcatgccagcgtggacacccaccatgccaggggtggcaatcggttccatctcgattgattggtgatggctacccagagcaccgcattgagcgtctaaggccactgtgctgtggttgattagcaatgtctgccactggctccgatgggatgtggtggcctgaatgccggtgatttgctgttcctggggtatagcacgtccactgaaaactcacaggggtagccgggagctgctcctcactttggccagtttgtctccagaaggagttcctcagaaaaaagggcacagtggattccattgattaga

SEQ ID NO: 135984 - DNA, 1515 bp, Homo sapiens; identical to SEQ ID NO: 135983
  Payload ID: 6595
  Gene Symbol: GPR20
  Gene Name: G protein-coupled receptor 20
  Uniprot ID: Q99678
  ENST ID: ENST00000613887
  CDS Start-End: 92-1168

SEQ ID NO: 135985 - DNA, 1170 bp, Homo sapiens
  Payload ID: 6596
  Gene Symbol: GPR21
  Gene Name: G protein-coupled receptor 21
  Uniprot ID: Q99679
  ENST ID: ENST00000373642
  CDS Start-End: 41-1090
aagcggcagcatgaagtgacagatcactcctgagctcaagatgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgataagcgctatgccatggtcctgtttcgaatcactagtgtattttacatcctctggttgccatatatcatctacttcttgttggaaagctccactggccacagcaaccgcttcgcatccttcttgaccacctggcttgctattagtaacagtttctgcaactgtgtaatttatagtctctccaacagtgtattccaaagaggactaaagcgcctctcaggggctatgtgtacttcttgtgcaagtcagactacagccaacgacccttacacagttagaagcaaaggccctcttaatggatgtcatatctgaagtggctcagttacggggttcccgtgtgtgtgtgtgtgtgtgtgtgtgtgtgtgtgtgtgtgtgtgtattttatctctaa

SEQ ID NO: 135986 - DNA, 2942 bp, Homo sapiens
  Payload ID: 6597
  Gene Symbol: GPR22
  Gene Name: G protein-coupled receptor 22
  Uniprot ID: Q99680
  ENST ID: ENST00000304402
  CDS Start-End: 1344-2645
attctgcaaaagctgcccgaacaggctttcctctgaaaagcagtgccgttcctttttagaaagactgaatctaaatgttgtctctggagacaagaagccttcagtatgttaaattactttcattatgtattttcagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatcaagaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacataattcctatcatctgaggaaattcctcttggccgtgactttttaaagcaaaacaaatacaaatattatgtactgttctttagaaatccatcagccaactaaatctcataatgcatgcagttgaagtattggagagaaaacgaaagaattcctacaagacatgaaataaaacacagctacttcactgttgtcagggaaaaaaaccaactgctccaaaagaatgtgtttttctcccattctggaaatcaacatgcagtctgaatctaacattacagtgcgagatgacattgatgacatcaacaccaatatgtaccaaccactatcatatccgttaagctttcaagtgtctctcaccggatttcttatgttagaaattgtgttgggacttggcagcaacctcactgtattggtactttactgcatgaaatccaacttaatcaactctgtcagtaacattattacaatgaatcttcatgtacttgatgtaataatttgtgtgggatgtattcctctaactatagttatccttctgctttcactggagagtaacactgctctcatttgctgtttccatgaggcttgtgtatcttttgcaagtgtctcaacagcaatcaacgtttttgctatcactttggacagatatgacatctctgtaaaacctgcaaaccgaattctgacaatgggcagagctgtaatgttaatgatatccatttggattttttcttttttctctttcctgattccttttattgaggtaaattttttcagtcttcaaagtggaaatacctgggaaaacaagacacttttatgtgtcagtacaaatgaatactacactgaactgggaatgtattatcacctgttagtacagatcccaatattctttttcactgttgtagtaatgttaatcacatacaccaaaatacttcaggctcttaatattcgaataggcacaagattttcaacagggcagaagaagaaagcaagaaagaaaaagacaatttctctaaccacacaacatgaggctacagacatgtcacaaagcagtggtgggagaaatgtagtctttggtgtaagaacttcagtttctgtaataattgccctccggcgagctgtgaaacgacaccgtgaacgacgagaaagacaaaagagagtcttcaggatgtctttattgattatttctacatttcttctctgctggacaccaatttctgttttaaataccaccattttatgtttaggcccaagtgaccttttagtaaaattaagattgtgttttttagtcatggcttatggaacaactatatttcaccctctattatatgcattcactagacaaaaatttcaaaaggtcttgaaaagtaaaatgaaaaagcgagttgtttctatagtagaagctgatcccctgcctaataatgctgtaatacacaactcttggatagatcctaaaagaaacaaaaaaattacctttgaagatagtgaaataagagaaaaatgtttagtgcctcaggttgtcacagactagagaaaagtctcagtttcaccaaatccacattcaaatgagttttaaatttaaattgtaaaaactgatattactgccaaatataagaaaaatattttaagtattggttatgttgtaaattttcaatgtgaatgtcaattagataggtcatatatattcaatttcttcattacttaatgtatttgttgcatggcagtttgttaaagtactatcatgtgtatattttgtcaatattatgtccaacagaaaatattcatgtaagtcatattttttaaggaataaatacatagccttaaaaca

SEQ ID NO: 135987 - DNA, 1086 bp, Homo sapiens
  Payload ID: 6598
  Gene Symbol: GPR25
  Gene Name: G protein-coupled receptor 25
  Uniprot ID: O00155
  ENST ID: ENST00000304244
  CDS Start-End: 1-1086
atggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggcgctaggcggccgctggccgttcggcgatggcctctgcaagctcagcagcttcgcgctggcgggcacgcgctgcgcgggcgcgctgctgctggcgggcatgagcgtggaccgctacctggccgtggtgaagctgctcgaggcgaggccactgcgcaccccgcgctgcgcgctggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtag

SEQ ID NO: 135988 - DNA, 7514 bp, Homo sapiens
  Payload ID: 6599
  Gene Symbol: GPR26
  Gene Name: G protein-coupled receptor 26
  Uniprot ID: Q8NDV2
  ENST ID: ENST00000284674
  CDS Start-End: 54-1067
cgccatggcggcgccgggttgcggaccctgagcgccggcgcggggcgcgcaccatgaactcgtgggacgcgggcctggcggggctactggtgggcacgatgggcgtctcgctgctgtccaacgcgctggtgctgctctgcctgctgcacagcgcggacatccgccgccaggcgccggcgctcttcaccctgaacctcacgtgcgggaacctgctgtgcaccgtggtcaacatgccgctcacgctggccggcgtcgtggcgcagcggcagccggcgggcgaccgcctgtgccgcctggctgccttcctcgacaccttcctggctgccaactccatgctcagcatggccgcgctcagcatcgaccgctgggtggccgtggtcttcccgctgagctaccgggccaagatgcgcctccgcgacgcggcgctcatggtggcctacacgtggctgcacgcgctcaccttcccagccgccgcgctcgccctgtcctggctcggcttccaccagctgtacgcctcgtgcacgctgtgcagccggcggccagacgagcgcctgcgcttcgccgtcttcactggcgccttccacgctctcagcttcctgctctccttcgtcgtgctctgctgcacgtacctcaaggtgctcaaggtggcccgcttccattgcaagcgcatcgacgtgatcaccatgcagacgctggtgctgctggtggacctgcaccccagtgtgcgggaacgctgtctggaggagcagaagcggaggcgacagcgagccaccaagaagatcagcaccttcatagggaccttccttgtgtgcttcgcgccctatgtgatcaccaggctagtggagctcttctccacggtgcccatcggctcccactggggggtgctgtccaagtgcttggcgtacagcaaggccgcatccgacccctttgtgtactccttactgcgacaccagtaccgcaaaagctgcaaggagattctgaacaggctcctgcacagacgctccatccactcctctggcctcacaggcgactctcacagccagaacattctgccggtgtctgagtgaaggaccgcgctcctgctgaagagtttagaatgaggcagcggtgagaagaagggtgggagggcgtgggggcccctgggtggacaccaccagccaccagtccctggcatgcccagtgatcctggttccctggcttgtaggggctccagagcctgcttcctggttcctcaagggcagatattggacactccttatttgtcaccaaaggatgactgtaggccgtgtgctggcctttctttctaagaagctgctttgagctcctggactcacctgaggctccctgggggatgacactcagttctgtcactgtcaaggatgcagagagctggtggtaggtgggaagcatggtgtccacctgcctgctgaccactggacgctgctccatgctgaagaaaagtgacagtctccaggggacatttcagccatgctgaaagggaggctggcagtggtcatttggcccggatctaacatggcacctcgtctccacagggtagtggtggctgcttcaacccaaatattattcagctggtactaacgacattgtgcccagctgggactcttgggctctgtgcctgagggaaaatgtttcacaactagtggctgcccaattgctgctgaccagttgtcttagaaatggtcaattggattcaactttagtcctctccttccccctaaaagcgaatgtttgtgtgtgcagacaatcttagcatgaaaatggtttaaataggctggtcctacatgtattaggttctttcaagtttgactgggaggtcacctttttctgatttacaagtcctaattgttggagctcagtaaaggtaggaggaaggtggctggttggtcctcccttccccctgtttgtgacctgaatttacaggaagtgtttcaacttgtcttatgcatcttatctggcatgtcctgggagatggatgggcaagaactggcctgagcagggatttttgccttgattttaagtcactgggttccattgtcctggcacctccatttccttagtttctgtaagcctgttaacagaaagtagaggctattcaaggttatcaagaaagtgccctgtgctaatgatgagacagtgaattttttttttttttcgagatgggagtttcactcttattgcccaggctagagtgcaatggtgcgatctaggctcaccacaacctctgccttccaggttcaagtgattagagacagtgaaatttttatggaatactgcacctataaaacacatgccaatctgttagcagtcctgacttgatttaataaaaaccaaggagagccacccctgctttctggccatctcttctttgtctaccatttcaaattgacttgtgaatactcagagcagttatttttcaatcctccactctaagtgattcctccagggtgggaagcacggggagcaatggaatcagatggctcattctctccttccagctctttacatcctaactttggaggtatagaaggaaggatgtggtccaacgggaaggaagtgaagagtctattggtttttacttctaggcagtcccaatttttaaaggcagagaagtatctgcatctttatttgaaaagacgtcttattaactcttagctcctcagttagaaaacaattcacctggcttagtcttgtctagtttcaaagttaccatggagactagaatggagacaggtgtagcttccaaggaggccttggcatcttgcagttgctgtcagagatgggctcatatctgcttggggaagccaatggggcacaatccttcccaatttcatgatctggggcatcatgtcggtagctgaagtcagccacggtgggagtgtttataccatgaaaatcagcaagtgctgtaaatcaggccttttgccccacagagagctgattgtgaaacatctactagcacaccactgccagacatgactgtgtgtgtccctgaaacaaaattgctctggctcagagctcctttggccactcatattacaatagcaacagacatttgcttcctggtggcaagtaactgtgcaccctccaacatcccaaccccagaggaaccagtgggattgaaaaccagcagaagccaagacaggatgcacagctgaattggaggagagtagctcccttctcacacaaacgctttcaaagttgggcaaaagtggcccagtgcgtgaggtcagtcaacagccaaattccagcagcaaaatacattttcatcaatatcactttgggagaataactgtggcacatgctctttctgctttctctgtactgtataggcaacatgttgtactcccagtagcaactagatctcttttacctcttctttagccaagaagcaagatctgtcacccacaacaccacatatcttgaaaagatgcttttcataattttcactatacctctaaaaccaattgtaccgacatcacgtagacaaaaactccagataaatccattgattgggtattttcattattatttggacacatgaattaaatcccaagggaaagtgagaagaaaattaatgtattagcaaccagtgttagccaactctgctgtaattacctttagataaatgtttattttcatctctatacagtctatcaaatttgccccctggctttattactcccaattgaattatctacctcattttgttaatttaatttatcaaaggtaacattgttttctcaggtataacacatagaaacaccaagattttcagcatctgaatcaaactaaaattacttgcttgacttcactccagggtgagacttgacctttaaggcccaaactctggtgaactgttggactgggtagaaatctttcaagaagcttgaaaataaggccataaaggaggggctttcaaattcctaaatccacatatagggctgagttcctagtcctacacaatcagaatttgcctttttaagtcacgctgcaactattccggctttttatatggcacctttctgagggaggggattttacagccgagggacctccaaagggaacgtccatttgcatgtgtgccctggtatttagggtttgtctcatggtcagctcgcctctcaaagatggctcaccaatcacctgcctgtttttacttagaaagcaggcttgggcaggaggggaaatggatttgaaccatctcagaccaactctatctcttctagcactcagctcagcctcctgtccccatgagcaataaaactctctccttatgtctgtgaaattcgttttctttttcatggtgcctttctttctaagaaaagatagaaagaatggggccaggttcatgtcccagttgtcacccttttacatgcttgggtgcaggtagatgaggccttcccatggctacagtgtgacccttggaggaaccaaaggctgtgcattgttagaatttagcccagatgcaggataaactagcttgcctgagtttaatgaggatattatatcaggtgccaggaatcccttgggtcagctcctatcctctggacggggagcatcatgggaaaaagaggtccgagtcatatttagggcttcatgtgtctggaagggagccattagctcttaaattattcacagaagtcaccacggaaggttgtttaagatgcagattccagcatcccctcctcagagatcaatttcagcagggccaggcaggacctgggtttccgcacttttaatcatcgatgcccaggtaactgataggagttttcttcaaaccatcccctaaggagaaatgatcttagacacttggataaactctatagaaaattgagtgtttctattaataactatctaggtttcaattgtcttgtatctttccctaattctccaaacagttcaatctccagctttattcaatggctgggccattttgttcttggagggacaaaattgacctctccatgaaattgcaaaaacccatcttcattcctttttatggggctccaggtcataaggatgagatatatttggggtactggcagaggatggcagagctggctggctctgagccaggaagccttgttagaggaaggaactctggcattcagaggtgtccccttgggggcacttgcttgggtcttggatcaaactctactggggcagcctggctgtgggaggtgatgacatctgccacctctgccactacccagagcttgtcctgccctcttcccagccagcctcacacacaggagctgagccaggctgaggcaaggtcagcgagagacagttctccatgccagtatctgggtgtgggtctcttgttggctcccagctcatcccgtgtggctgacccttccaggtcacttggagcagccagtaatgacagtgtcctaacagctggtgggtatggaggaaagactagacatcaggctatggactcacatggagggccctggtgttggctctgggacctgggctgggccggacctggggagagggtgggtggagcttggcctctgcagtttgcgcttgcaggttcaggggagaaagttgtttgagatcagggtttaggggtagtgtttcccattaatcttcatcataatcttttgatgtaggtgctgttattatctctacgttacacatctgggaggatttgaaagtcctggagacagggaggttttggggagaatgcaaaacagggcagggctctcaaggagggtggaccagtgaccatggggaaactgagtgtttctattaataagtatctaagtttcaattgtcttgtatctttccctaattctccaaacggttcaatctccagttttattcagggactgggccattttgttctcagagggacaaaactgatctctccatgaaatcccctgcacctcactctgggcagctctaggctcagcagatgtttttctgccattaggaaacagccccttactctcagctcctgtgctaacacccatacccaccagctgggcgttgggacctctcccgtcatatggctgccacttgcttgggaaggaattctccagactccttttactttgtatgtgtttctaggggaattctgagggaagaagctttgcagcaacctctgtgcccagaacatacggctcacaagtcctttgtgccgacagggaatctatctaattgttttagtgtgtgaggctcattgtcagcctagatttccctgaaactctgggccagcagcccccaggagcatcagtaggacccagcatttcccctggcaccaaagtggacctctttgcaccttgcagccgggagaactgacttagagggccctggtgttggctctggaacctgggctgagatggattcggggagaggctgggtggagcttggcctctacggtctgttcttgcagattcaggagagaaagtggtatgagagcagtgtggtttgtaagttccccaacttccccgctggctcacactgtctccccagaccaatggcctattagcccccaaaaagttagtccaaccccaggccagctgcctttgctctgctgtggcctaagttctggcctggtcaaaggaaggtggcaggaactccaggcttgctcctgcctcctcacacctcattccacaaatgcggagtgaaagagcaggagccagacacatttgggggttgactgtctagaaaggaggaatcagaggtcccaaggaacacaatcgtgcaacttcctagggaatctgcatcaggagaaagaagcggctaggacacacagtggcttcgctcagcctggccacgacatcactgtgcagaagaagagatctgtcaggggtccagaggagcggagtcctggagcctctgggagggtggcatgtggcagctgcaggctgtggtccagaactatgagcagacttgcctgtcactctccaaacatttactgaacacctactgtgtgccaggccctgtgctttgtcaggctctgggggagacaggtcattactctgcagtgtgggaagcggggctgccctggaagtgtgtactcagtgctgtgggggtacagagggagggctggagaacttagctggtgggaaaggagggttctggaaggcttctcagaggtagtggcattgggccagaacttacagtagggaagagcatgtggcaaggcacagaggagatgggagcctgcctggtgaggggtccagtggtgacagagctcagtgtgggtccagagatggtgtcaggtgagggctgagaggggagggcaagtgccccttgagatgggctgaacgtgatgatgatctgtggccagtgggagatgatagaagtcttgaggttgggaatataagaattaggtctcttttagaaagagaggacatggagaaaatccatatatttttagctaccaaaaaagagaaggaagaaagaaaagaaataagaagagaagcaagacagaaaagaaggaagagagaaggaagaatggcaaaggaaggaagaaggag

SEQ ID NO: 135989 - DNA, 2447 bp, Homo sapiens
  Payload ID: 6600
  Gene Symbol: GPR27
  Gene Name: G protein-coupled receptor 27
  Uniprot ID: Q9NS67
  ENST ID: ENST00000304411
  CDS Start-End: 1-1128
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgttctactgatggttgttttaaattaataatgagaactataatttaaataatatttctttgttagacattataatgttaaactgaaagactaaattctgcaagtactatataatatttttggcttataatgctacatttttattaatgtaccttccgttttgaggatttatatctgtatttctctttgcattatacaaatataccagtattttcattctgga

SEQ ID NO: 135990 - DNA, 2115 bp, Homo sapiens
  Payload ID: 6601
  Gene Symbol: GPR3
  Gene Name: G protein-coupled receptor 3
  Uniprot ID: P46089
  ENST ID: ENST00000374024
  CDS Start-End: 100-1092
cggccgcgggggcttctcggggtccacgcacgccctgcgccgccaggacccgagcggagcctccccgcggcccggccgcgcctggtcctgagcggtaccatgatgtggggtgcaggcagccctctggcctggctctcagctggctcaggcaacgtgaatgtaagcagcgtgggcccagcagaggggcccacaggtccagccgcaccactgccctcgcctaaggcctgggatgtggtgctctgcatctcaggcaccctggtgtcctgcgagaatgcgctagtggtggccatcatcgtgggcactcctgccttccgtgcccccatgttcctgctggtgggcagcctggccgtggcagacctgctggcaggcctgggcctggtcctgcactttgctgctgtcttctgcatcggctcagcggagatgagcctggtgctggttggcgtgctggcaatggcctttaccgccagcatcggcagtctactggccatcactgtcgaccgctacctttctctgtacaatgccctcacctactattcagagacaacagtgacacggacctatgtgatgctggccttagtgtggggaggtgccctgggcctggggctgctgcctgtgctggcctggaactgcctggatggcctgaccacatgtggcgtggtttatccactctccaagaaccatctggtagttctggccattgccttcttcatggtgtttggcatcatgctgcagctctacgcccaaatctgccgcatcgtctgccgccatgcccagcagattgcccttcagcggcacctgctgcctgcctcccactatgtggccacccgcaagggcattgccacactggccgtggtgcttggagcctttgccgcctgctggttgcccttcactgtctactgcctgctgggtgatgcccactctccacctctctacacctatcttaccttgctccctgccacctacaactccatgatcaaccctatcatctacgccttccgcaaccaggatgtgcagaaagtgctgtgggctgtctgctgctgctgttcctcttccaagatccccttccgatcccgctcccccagtgatgtctagctgagtcttcatgacccttcaaccctgattactacagaattccagaatgttaggctctccagggcttctttccaaacccccagctccacaccccccagacccagctggttctggagttctaggacattgggtgtttcaaggttctgttcagatccctatgggggcccagctggctccacggttccagaatgttcaggtggtcagtgttctactcagaaatgtctcacagcccagctgggttgcaattccagaatgctgggagttttacagtgccattccaagtcccagatgtccctcttcccccaaacttgaccttgaccatgtcactttatgtttgaatttctgagctaaagagtcagagagattagtcacatagttgcctaaataggagagagaaagattatatatgcacatatacaaagacagtgtctatttatgattgatttatttatttataaatttacttatgggtggtaaggggcaaaaaagaggcccacaccttgatatccaggccataccagggtatcccttgtcccttcacccccatttctgacctcagttcctggaggggggaaagggtgaaagagaaaccacgtattttgttattattttggattattttttatcgaagagatcatagaaaccagagccttctccccaggcctgccctcctcgggtttggaaggggaacacaccagcctctggttttttatttttttaagaagccatcacctgagcaaccaaaaattcctctgcgctggggtccgactgccctctggtggccatttggggaaaactgcagcccggccaggcagctgggaccagaatgcaaccccagctccactccagcctggcgtccagggccacagccatggcctgggggccaagcctcaccctgcggtgccctaaaggagggggggcacgagccaacaccccacccctctgccaaccggggtatggcccccagtgcattccctgttcccgtctccaacccaactcaataaaaaatgattttgtcataaa

SEQ ID NO: 135991 - DNA, 2059 bp, Homo sapiens
  Payload ID: 6602
  Gene Symbol: GPR31
  Gene Name: G protein-coupled receptor 31
  Uniprot ID: O00270
  ENST ID: ENST00000366834
  CDS Start-End: 499-1458
ggatcccagcaagcgtcctttatgtatgaaaaggaagaagaaaatttccccatgaaacatattcaaagtagagaacaatctttttgattccattgttattttaattgtatacagacataggagtctttgcataattagacttttccttctttcaggactgtggatgcaaagccctggacccccagacgttataggacattactcctcagctttgcagcccggtgatgtgaagcgaaacaccatttccccttttttatggcggaagaaaacagaacacaactgcaaaggggcttttccctcccctgctcatcctctttccccaaatgaattttggtttgctgtggactctattctgctgaggaactgttcttgttgggcaaatgtagatcttgtctactctgtggcaggaaaaggccttttctttcattttgtaagaaagagcacagagttcctcctgtacctgctccagctgtgcctgcagcccctcacggccgggtgatgccattcccaaactgctcagcccccagcactgtggtggccacagctgtgggtgtcttgctggggctggagtgtgggctgggtctgctgggcaacgcggtggcgctgtggaccttcctgttccgggtcagggtgtggaagccgtacgctgtctacctgctcaacctggccctggctgacctgctgttggctgcgtgcctgcctttcctggccgccttctacctgagcctccaggcttggcatctgggccgtgtgggctgctgggccctgcacttcctgctggacctcagccgcagcgtggggatggccttcctggccgccgtggctttggaccggtacctccgtgtggtccaccctcggcttaaggtcaacctgctgtctcctcaggcggccctgggggtctcgggcctcgtctggctcctgatggtcgccctcacctgcccgggcttgctcatctctgaggccgcccagaactccaccaggtgccacagtttctactccagggcagacggctccttcagcatcatctggcaggaagcactctcctgccttcagtttgtcctcccctttggcctcatcgtgttctgcaatgcaggcatcatcagggctctccagaaaagactccgggagcctgagaaacagcccaagcttcagcgggcccaggcactggtcaccttggtggtggtgctgtttgctctgtgctttctgccctgcttcctggccagagtcctgatgcacatcttccagaatctggggagctgcagggccctttgtgcagtggctcatacctcggatgtcacgggcagcctcacctacctgcacagtgtgctcaaccccgtggtatactgcttctccagccccaccttcaggagctcctatcggagggtcttccacaccctccgaggcaaagggcaggcagcagagcccccagatttcaaccccagagactcctattcctgacaacagccagcgtcctcaacgcccgtgtttatggaactacctgcgacctaaataataattactcctactttgggattctggaagaagaagaagtcttaagactgcaatacaaggatcagagcataaacatgggcacagttgctgcaggtgtggtcttatactttgttgaccagggtggtcctctgtgattttaccttgtagagtggcaaatcaaaatgaacaagctagaacctcctcctacccaactatgatgcagattcagttgctgaactgaaaagtcgggcagctactccatctccacacttgaagaaatgtaatttgctaaatcagtgaaggaagagaagaaagccgggtgatggcatctttccaactcttacttggtctcagcaagtcattttcatttattatgcttcagttttaaatacaaaaaaaaaactatgttttcttcccacctgctgtgcagactggggatgaccgacatcagaaagtgccctggttctaaaaagagactctgctgtatataaggtactgtcgtacatgctagcctttatttggaacataacatttttgttttcataaaattttgcttcatttttctaga

SEQ ID NO: 135992 - DNA, 1269 bp, Homo sapiens
  Payload ID: 6603
  Gene Symbol: GPR32
  Gene Name: G protein-coupled receptor 32
  Uniprot ID: O75388
  ENST ID: ENST00000270590
  CDS Start-End: 138-1208
tcttgagcctaggaggtggaggctgcagtgatctgtgattgtacctttgcactccagcctgggtgacagagcatgacgctgtctctaaaagaataataataataagcattccataaaaattatggaatggagaaatcatgaatggggtctcggaggggaccagaggctgcagtgacaggcaacctggggtcctgacacgtgatcgctcttgttccaggaagatgaactcttccggatgcctgtctgaggaggtggggtccctccgcccactgactgtggttatcctgtctgcgtccattgtcgtcggagtgctgggcaatgggctggtgctgtggatgactgtcttccgtatggcacgcacggtctccaccgtctgcttcttccacctggcccttgccgatttcatgctctcactgtctctgcccattgccatgtactatattgtctccaggcagtggctcctcggagagtgggcctgcaaactctacatcacctttgtgttcctcagctactttgccagtaactgcctccttgtcttcatctctgtggaccgttgcatctctgtcctctaccccgtctgggccctgaaccaccgcactgtgcagcgggcgagctggctggcctttggggtgtggctcctggccgccgccttgtgctctgcgcacctgaaattccggacaaccagaaaatggaatggctgtacgcactgctacttggcgttcaactctgacaatgagactgcccagatttggattgaaggggtcgtggagggacacattatagggaccattggccacttcctgctgggcttcctggggcccttagcaatcataggcacctgcgcccacctcatccgggccaagctcttgcgggagggctgggtccatgccaaccggcccaagaggctgctgctggtgctggtgagcgctttctttatcttctggtccccgtttaacgtggtgctgttggtccatctgtggcgacgggtgatgctcaaggaaatctaccacccccggatgctgctcatcctccaggctagctttgccttgggctgtgtcaacagcagcctcaaccccttcctctacgtcttcgttggcagagatttccaagaaaagtttttccagtctttgacttctgccctggcgagggcgtttggagaggaggagtttctgtcatcctgtccccgtggcaacgccccccgggaatgatggaagacttcagctggaagctggaagccgtccttcttagtttgcttgtggcctcttacct

SEQ ID NO: 135993 - DNA, 1057 bp, Homo sapiens
  Payload ID: 6604
  Gene Symbol: GPR33
  Gene Name: G protein-coupled receptor 33 (gene/pseudogene)
  Uniprot ID: Q49SQ1
  ENST ID: ENST00000399285
  CDS Start-End: 56-1057
tcactttggcctgctcaagaccaatctggcatgaagatacaggtctgaggtcattatggatctgatcaactctactgattacctgatcaatgcctctactttagtaagaaacagcactcagtttctagctcctgcatcaaaaatgattattgccctttctttgtacatttcatctataattggtaccatcaccaatggcctctatctatgggtgctaagattcaagatgaaacagactgtcaatactctcttattttttcatctcattctctcttattttatttcaacaatgattctgccatttatggccacctcccaacttcaagacaatcactggaactttggaactgccttgtgcaaggtcttcaatggcactttgtctctggggatgttcacctctgttttcttcctttcggccatcggtcttgatcgttaccttctcactcttcacccagtgtggtcccagcagcaccgaaccccgcgctgggcttccagcattgtcctgggagtctggatttcagccgctgccctcagcatcccctatttgattttcagagagacacatcatgaccgtaaaggaaaggtgacttgccaaaataactatgctgtgtctactaactgggaaagcaaggagatgcaagcatcaaggcagtggattcatgtggcctgtttcatcagccgcttcttgctgggctttcttctgcctttcttcatcatcatcttttgttatgaaagagtagccagcaaggtgaaagagaggagcctgtttaaatccagcaagcccttcaaagttatgatgactgccattatctctttctttgtgtgttggatgccctaccatatacaccagggcttacttctcactacgaaccagtcactacttttagagttgactttgatacttacagtgctaaccacttctttcaatactatcttttctcccacactctacttatttgttggggagaatttcaaaaaggtcttcaagaagtccattcttgctctgtttgagtcaacatttagtgaagattcttctgtagaaaggacacaaacctaa

SEQ ID NO: 135994 - DNA, 1815 bp, Homo sapiens
  Payload ID: 6605
  Gene Symbol: GPR34
  Gene Name: G protein-coupled receptor 34
  Uniprot ID: Q9UPC5
  ENST ID: ENST00000378138
  CDS Start-End: 176-1321
agctgacacaaccaagacgagtctcagtgtctagggaagcttggggttctgctccttttacttcaggcgaacctgaactttaatgcaattttgaagcatgccctgaatagattcagtcattatcaagtcaaactaaaaacggtgaaaggttgcgactattaccaaatagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactaacttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaat

SEQ ID NO: 135995 - DNA, 1928 bp, Homo sapiens
  Payload ID: 6605
  Gene Symbol: GPR34
  Gene Name: G protein-coupled receptor 34
  Uniprot ID: Q9UPC5
  ENST ID: ENST00000378142
  CDS Start-End: 285-1430
aaccaattgcaccacgaccggatggaagagcccagctgacacaaccaagacgagtctcagtgtctagggaagcttggggttctgctccttttacttcaggcgaacctgaactcagttaatgcaattttgaagcatgccctgaatagattcagtcattatcaagtcaaactaaaaacggtgaaaggttgcgactattaccaaataggaaaaatctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactaacttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaatgaga

SEQ ID NO: 135996 - DNA, 1282 bp, Homo sapiens
  Payload ID: 6605
  Gene Symbol: GPR34
  Gene Name: G protein-coupled receptor 34
  ENST ID: ENST00000620846
  CDS Start-End: 278-1282
ggttctgctccttttacttcaggcgaacctgaactcagttaatgcaattttgaagcatgccctgaatagattcagtcattatcaagtcaaactaaaaacggtgaaaggttgcgactattaccaaataggaaaaatctgaagacataagaactacacatgaggaatatgtcatttagcactttcactttttgatctccacagaagacaatgagaagtcataccataacaatgacgacaacttcagtcagcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttga

SEQ ID NO: 135997 - DNA, 2249 bp, Homo sapiens
  Payload ID: 6606
  Gene Symbol: GPR35
  Gene Name: G protein-coupled receptor 35
  Uniprot ID: Q9HC97
  ENST ID: ENST00000319838
  CDS Start-End: 943-1872
ctttagtcacttccagctccaggcacagcagttggtgactccttggtgggagccgtgtcccacccggtcctgatactgccgtcttctctttcacagtcctccaggcttgggccagccttgggggcagcagagcttctgggctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtcagtccta

SEQ ID NO: 135998 - DNA, 1258 bp, Homo sapiens
  Payload ID: 6606
  Gene Symbol: GPR35
  Gene Name: G protein-coupled receptor 35
  Uniprot ID: Q9HC97
  ENST ID: ENST00000407714
  CDS Start-End: 329-1258
agaacaaatgtgtgccctcagcaaggatgctggctcttcagaggtgtcagcacaggcagccggcaccccacttccctcccagaaatcccccacgccctctagctggggctggtgcaggagcagtggggaactcctgttacccctgacctgctgccgtcagtcagccgcccgcccccccaccttaaggaggggcagagtcagggaccagccctgaggggtggctcaccccagcttcacttcccccagcccttctcagacagccactgtgcaggctttggcagcgggggtcacacactccacccgggaggccaaagctgcctgcaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaa

SEQ ID NO: 135999 - DNA, 2032 bp, Homo sapiens
  Payload ID: 6606
  Gene Symbol: GPR35
  Gene Name: G protein-coupled receptor 35
  Uniprot ID: Q9HC97
  ENST ID: ENST00000403859
  CDS Start-End: 815-1744
agctccaggcacagcagttggtgactccttggtgggagccgtgtcccacccggtcctgatactgccgtcttctctttcacagtcctccaggcttgggccagccttgggggcagcagagcttctgggctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagt

SEQ ID NO: 136000 - DNA, 1399 bp, Homo sapiens
  Payload ID: 6606
  Gene Symbol: GPR35
  Gene Name: G protein-coupled receptor 35
  Uniprot ID: Q9HC97
  ENST ID: ENST00000430267
  CDS Start-End: 1-1023
atgctgagtggttcccgggctgtccccactccacaccgtggcagtgaagagctgctgaagtacatgcttcatagtccttgcgtctctctgaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtcagtcct

SEQ ID NO: 136001 - DNA, 3821 bp, Homo sapiens
  Payload ID: 6606
  Gene Symbol: GPR35
  Gene Name: G protein-coupled receptor 35
  Uniprot ID: Q9HC97
  ENST ID: ENST00000438013
  CDS Start-End: 2521-3450
tataaacaggaaaatttaaatgttgtagttagagtttttttcttcttcttagagatggggtttcactctgtctcctaaggctggagtgcagtggtgggatcatagctcacttcagcctcaacctcctgggctcaagccgtcttcctgcctcagcctcccgagtagcacgcatcaccagcccagctaattttctgtctttttttttttttttttttttttttttgtagagacggggtctccctgtgatgcccaggttgttcttaaacttctggcctcaagtcatcctcctgtctcagcctcccaaagtgttgggattacaggcatgagccaccgtgcctgcctgcagttaaacattcccccacaaaatactgggccacaccgaggctagtatgaaagttgcagccctgggtatgtgtgacctgagagccccttggcagccatggggagcgatgggggaagctggggcaatgggaaggggtctaggcacacgagccctcgggtcctcacctcccacgaggcagggtcccaggctgcctctactcaaggtggggcagcaaaagaatcgccctctagctgtgcagaccccctccccctccaggtctgcacaccgcccaaggctggccctggacttctggtggattcaagtactcaggtggggagagtaggaggccagtcgcacggagccctccccaacgcacagtgcctgcccagctcaggtgcctctgaggtgtagattctgagcaggttctgggatctcctggcccccagcgggggctgccacaggagtataggcccaacaggaagggaagatcccagcgattggttccagtgggttctggggatgtcctcggagcctggcctggctcagggtccctccaaaagtccctggaacgagggtgaagtgttgctcatgaatcagagagaaagcaagcaggaccctcaagaagggaggagagagaccactgggcgtgcagcactttgcactcgggggaagggctcctgaaacttggaagtcagcaaatatctgctgtacttcaccagaggtgggatctaaggagacagaatgaagccagggggcagaatgtttcgtttctgtctgaaacctgtgccctccatccctcatggactggggacctggagttcccggggaccaccgtggggaaatgcgtcccagcactaatggtccccagcagctgcagtcacggggtttgggcgctctcccctcctgatttgggggaccttttgtgctcctctgggcagagggaggaggcagagggaggaggaaggcccttcgctgtgggctgagtccttcccaccttccataccagcccagcaggaagccactgcaggatgccccagaggacagcctgatggttgggggagaggcttctcccgccctcacccctccgggttcttcctggacccactgagtaacccaggtggtgggacgtgtggctgtgagtcctggactctgggcgctcaccagcagctccgtctcacacctgcctgcgtgtgacaccagcaccccttatgatgaggaaacaagtttgcccagctgcaggggtggccgagtcaggatgactctagcccgtgtcctggacaccagaccctgcccaggtccagccggggctggtctcagccttcctgggctatgtcgcggagggtgttggggacagcgagaggctggcgtggacagtggaggggtgactttgtgggtggtcctgatagtgacggagaggaggatactcagctccacccctgggcggcccctgagcagcacgactgggcctgaaggggcagggctgccgtcacaggctctggcccctgggagctcaaggggtgaatccctgatcccaggtgtgggactgggatggggcctcaggctgatgcaggcaggacctccagagctcaggactgggtgggtgggctcacagggaggtaggggcaggccagagtcccagctgtcctggactctgctgtggggaagggctgatgcaggtgtggagtcaaatgtgggtgcctcctgcagccgggtgccaggaggggtggaggggccaccctgggctttgtccgggagcctggtcttcccgtccttgggctgacaggtgctgctgcctctgagccctccctgctaagagctgtgtgctgggtaaggctggtggccctttgggctccctgtccaggatttgcgctctggagggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcactctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtca

SEQ ID NO: 136002 - DNA, 3021 bp, Homo sapiens
  Payload ID: 6607
  Gene Symbol: GPR37
  Gene Name: G protein-coupled receptor 37 (endothelin receptor type B-like)
  Uniprot ID: O15354
  ENST ID: ENST00000303921
  CDS Start-End: 652-2493
ggggttggaatcccgcttctcctcggcagcagtaggctcgcaagtcgctggggttaggtggggcaagagtttcgccggcgcatcagcgctgcttcggactgtttgcaacgtgtttccagcgagctgggagcggggttgtgactgcgagtcgtctgggggagggggacttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccactttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattgattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaagatacaa

SEQ ID NO: 136003 - DNA, 6588 bp, Homo sapiens
  Payload ID: 6608
  Gene Symbol: GPR37L1
  Gene Name: G protein-coupled receptor 37 like 1
  Uniprot ID: O60883
  ENST ID: ENST00000367282
  CDS Start-End: 107-1552
gactggaggcggatccagccggccagctgcctctctggagcccagctcttgggccccctgcactcacctgctcttcctgggctggctgtctcctgctcatccagccatgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccggcaaggatgggggcaccccagacagtgggcaggaactgaggggcaatctgacaggagcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagtgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctgaggccccagtaggggtggggagggagggagaggccgccacccccgccggtgtctgctgttctttccccataggtcttgctttgttgcctgtcttgctgtctagggatggacttggttcctcttgtcaaggtttgggaatgtcaaagccccctccccacacagggcctttcctgtcccttgtggggccttccaaccctgtcctttccactggtgggcggtgatgcttctaggtccttagaactgcccagaaactctgagtcccagcagctgggagccagaactttgcctgccctcccttggttccagtctctcttctctctctctgccttggaacctgaccatactttagttgtgcccttcccaggcatcatcctcctaccaccaacctggggccccatcttggaatgggggctccttggggccagcccagtgtggctcaccacactcttctttttttttttttttttttttgagatggagtcttgctctgttgcccaggctggagtacatttgcctgatgtcagctccctgcaacctccgcctcctgggttcaagcgattctcctgcctcagcctcctgagtagctgggattacaggtgtgcaccaacacacccggctaatttttgtatttgtagaagaggcggggtttcaccatgttggccaggctggtgttgaactcctgacctcaagtgatctgcctgccttggcctcccaaagtgctgggattacaggtgtgagctgccacgcccagccccagtacactcttctctggaccagatctgtcccagtcctggatgcctcctcctactggtgccttcttttcttccagaggatttctctctccttcctcctcctttctttgggatccctgggttgccctgtcccaacctccttgttaggtgctttcccataggaggcccttcttgagaaacaataaactaggtagaactacccctatgcccatccactttcttgtgccacattctggcagggcccagatgcagctgggccttcctggcctggcagtgcctaggagaatttctcctgacctggcctggcctgtggctgatgttcagaacagccttgtggccgatgttcagaacagccttgtggccctggcgactccaagggttttatggcttttgagggacagagaggatggagggcttggggagccggaggacctaagtcctcatcctggcctaaaccccatgctccttgggaagtcaaaagcctggaaaatatctcctctggagccttcatctctgctatgccctctctccacaaagccccccttggagggagtccagtggtctttcctctgtgagccccagggcttcccagcctttgtcactctgagagctgctcttgttcagtttcttagaatggactgttttgcctgtagacggcccagctgcctgccctggcctgcccccacccagcccccactgcaccacccttcccgccagagctcccactgcccccggcagacccttcatgcagcttctcctgtggggtcttgcccttgaagtgccacttcccccagccccacctctggtcccttccagagggcacccttagccttgtaggtccctgggaagctggcacagcatcaaccagaagtgatgcctcagccaggccaccagtcgctccccgcctgggagctcagctttcctcagaaccaccccccctgtctgaagctctgtcctgggtcccaccagacttctgcccaccaggcctacctacagcatccacatggggcctcaggaagggccccgggggcccagggatgggcaggggcagggtttccaagcgcctggggctccattctcctctgtccacccacccacaccccttggcctcagcctgccctgtacccaagcttccctccccctctcctggggatcttaacggccttgttctctctccctggcacccacccccagggcgggtgatgccgccaagagagagggaggccgttgctaggtgatggcgccgccatgcacacaccctttgtgctggggagtgacacccacccgtttctcagcagacctgttgccacggtgactgaagcccccagctctgtctgtagaaacttcagatgggtgggggagcaggttggagaggggaccaaaggcaggcctgtcgtgctgaagctcttggggaccgtttcctcggcatttccccaactccttctccacccccctgccaggcccggaagtaccaccagcttcctaagggatgcaggaaggggccgggtgaactgaggtgaagtccagggcaggggagtcagacccctcaacatcctgtttaggggtcctcctccacaaagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccgagggcagacttcagaccagccctcagatcctgatgccaggttacagggctgaggggagcctgaaatccactgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatacataaagcactttgcatggtgccccgaaccttttattccttcctctcctttgggaattcaattctctagtgttaggagcaggcttggcccagggattcttaaatgcatccaggttttggcatcaaagggccccaaacatgacaatttacctatactcatggtctgttcccattcaactttaataggttatgtgtgttttttttttcttaagagctgggtgggggggtctcactatgttgcccaggctggctttgaactcctgggctcaagcagtcctcctgtctcagcctcctgagtagctgggactacaagtgtgtaccaccatgcctggctgaacacttttttttttttgagacaagatcccactcagtcactcaagctgagtgctgtggtgtgatcacagctcattgcagcctccacttcctgggctcaagcgattctcctgcctcagcttcctgagtagctgggactacaggtgcgcactaccacgcctgtctaatttttgattatttgtagagatagggtctcactattttgcccaggctggtctcaaactcccagactcaagtcattctcctacctcgggctcccaaagtactgggattacaggcatgagcacctggcccctgaacaaattctttaagtcatattagcacctgctgcacgccggcactgtggaaggaggatgcttgcttgcttcctggtaaccagctctcttatctcaaacctcaatcctcagtgaggatcacaggatctgagaaaggcaccttggcctggaaacagccccagatgagtgagattgctggtcctctcccgggatcccaggcccaggaaaacctagccatgcttgcagtcaggagagggcaggggatagagccctggctcccattcaacctccttagccaggaggacatgtcccattttgcttaggagttgggaggtaccctagaatcacttagcttcagatgccaaattccatccacattctttcctccaactctctggcagtggggaactgcctctccaggcagggaactgctctgacaggtctgatgactgcctccaggaggaagccctgggcaccaatgaaggtgaggggctggagggcccaggacggggagtcaaggtccccactcccaggactaagggacagtttggctcctttttcctgcagtgggaggggtgagaagggctggggtgttctgcaagggcctgctccattttccagggtgaaggagaggccgagggaggtggagcgggaggaggtggggcttactgtgaaactgggtcaagatggcctcggatttgagcaggcagggtcaccaggctctgaggcagcagctgtgagcagtgccgagggaggaccagctctgacggtgaggtcgggtgggggactagaatccagcagaggagcgagggcagggctcctaccaggaaacccatagcattgacactaactgagaggcagcaaaggcggtgacactcccccaggctctgtgggcccagccctacccctgaagcacagttaactggttctggggtaggaactgggggccggagggacagggttctggttctggctcaaccttggctgctggtgagatccagggcctgggaaagaggggctgaggcctgaactgggcctaaggagagtgcagctcagttcgcacacaacagcacccagccctgtccccttgctgcctctacccagccctgggcagttccctcaacagagctctgcagccccaagtggcagctgctggctcaaagctgggactacatgaaagtctgaaaagagaatgagaaggaggtggcgcaagagcctggacgcacgtgtgggaggccgttttgtgcagcgccattgtgctccccgggcgggcatgtgctcgcgctccgtggctctgttggtgcccagcgtgcgggggtgtgctggtggccctgtgggcctgtagggcaacccatgccaactgcggaaaagtaaccagcaccatacaccccccccaacacaaaactggtcatttattttttttgttgtcattgttattaggaagcaaaaaaatgtacagttacaagaatcattttccaaacagaggttaaatatgagctgaaaagtgtaaaaaaggaagaggaacatcactttacaaatcattaaattaaacaaataaacaaacagaacccaaagaaccaa

SEQ ID NO: 136004 - DNA, 2784 bp, Homo sapiens
  Payload ID: 6609
  Gene Symbol: GPR39
  Gene Name: G protein-coupled receptor 39
  Uniprot ID: O43194
  ENST ID: ENST00000329321
  CDS Start-End: 470-1831
atgattaatcgctgaccaccccgcctcccgcagctcgggagagggtgctctgggaatgtggaccggggctctcaagtgccggcagctggaaaggaagaggagtgctgcgaggcggagtgcgccctcggcgaagaggggcagaggcggagcgccaggtgctgcggtctcactcccagccagccaggagtttagaacgttcttcctccgccctctccccgcctcgccccagccacatacactcccaaacctcaacacccaggcgcctcctgggcctctcctaggttgggctgctccagcaagtttccatgaaagcacctgaaatactaagttaccttcgcgaggagaactcgagtgagataaaatcgtgcgcccacgcaggtgagtttgcagccaagaattttggacgctgctgggaggagaaagggaagttgagaaagtctttggacctggtagcctggtgctctttctcatggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccacctccttccttcaagtacatactgaaaattcagtcaggctgaatttattcagaatgctttaccgagctctttcattatttgcacaggaacaaaagagaacacggactcccgctccctacccagaataaaaggacacccagaagaaactcactcagggaggtggggggttgggggcgagggctggaagaacaatgcaggagggggtggcatctccttcagcttcagcagtgtgccgagaagagggctaatttgaggaacaggatggtggtgcggagccctggcctgagggccgaggcagaacttccccttttcttgggccttggcccgttacaaagaggggtgttgcagcagctgatgcaaactgagttcagtttccctggggagcagaaggactggtacccggcagaggcgatgagacaggccgctgatgatgcacaggacttgcggtacatgatccctgtaacacagacccaaaggagctgagttaacgtgcaccggcaaaagaatagctgtccctctcagcccaaatccaaacggacagctcttccttactcctcccacagcccagagactaggtgaggtcagggaagtgcttcggattgtctcattgatattcaagatagatggtgaaagagacaggcactatttcattagttttaacaaaactgttccaaaagcgatttgagatgccaatacctgtgaatacctgttaataaagagctgttaaatagactta

SEQ ID NO: 136005 - DNA, 900 bp, Homo sapiens
  Payload ID: 6609
  Gene Symbol: GPR39
  Gene Name: G protein-coupled receptor 39
  ENST ID: ENST00000622084
  CDS Start-End: 1-900
atggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggcttgggtttctgccactgtgggtctgttccttaccagaccag

SEQ ID NO: 136006 - DNA, 3048 bp, Homo sapiens
  Payload ID: 6610
  Gene Symbol: GPR4
  Gene Name: G protein-coupled receptor 4
  Uniprot ID: P46093
  ENST ID: ENST00000323040
  CDS Start-End: 946-2034
gctgttctgccccgcgggggcatccgctgggtccccgcgccgttgtcaagaccggggacctggacgcagcggagagaggtgccgccgcccgccccgtccagtcgccgcgcgcaggcactgcagtcagcggtgaactgacttcatcccaatccctcagcccccaccaggaccagtctggagtccctcccctgcccccattgaaatttcccttccgtccccaaacttacctctgatctagaccttactcacctccttcctgtttcctaagactccttcctgccgtccacagaccgagccttttatctttgtccaccctgtgccagacacctccttttccagaaccttctccttactggtgaccttacttatctctgttgctttctggggtcctaggaaatgccagcactcccacccacattgcctgaactttccaacactccctaactgcgctgtgtcctatctcaacactttctcatgtatttcttgtgtcttctagaacattcccccgccattattacttcaatatggctacacatacttcctaattgccctgcaaaccatctccttctcaccattgcccagcgatgctttcgtctcctccataaacactcccggagaccaatttttgtgtcacccccatactccctcgttgacacactgactccatacataacctccttgaaaaacctctttattaatctcaccatcctccagacttccctcctgtcataattccatccctcctccaacttttccctctcaagctctgcccttcccagcccagcccagcctacccaacctcatctcttccctgtagaccacatcccaccatgttcccctgagcctccaaggaaggggctcagggggccccatggcctcccgctccctgtggccccacagcccccgtgggccaggggaagcgccccagaagccgaagtgcccaccatgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgatgaacctcagcatcgccgacctgctgtacatctgcacgctgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgccctcccagggggaccaggtgcagctgaagatgctgccgccagcacaatgaaccccgagtggcacagaatccccagttttcccctctcatcccacagtcccttctctcctggtctggtgtatgcaaattgtatggaaaaagggctgtgttaatattcataagaatacaagaacttaggaagagtgaggttggtgtgtcactggtcaacctttgtgctcccagatcccatcacagtttggcgattgtggagggcctcctgaaggaggagatgagtaaatatatttttttggagacagggtctcactgtgttgcccaggctggagtgcagtagtgcagtcgtggctcactgcagcctccacctcctgggctctccagcgatcttcccacatcagcctcccgagtagctgggaccacaaatgtgagccaccatgcctggctaatttttgtactttttgtagaaatggagtctcactatgtttcccaggctgatcttgaactcctgggctcaagagatcctcctgccttggcctcccaaagtgctcagattagagatgtgagccgccatgtctggccagataaattaagtcaaacatttggtttccagaaaataaagacaaatagagaaggttagatttttttttttccaacaagtggataaaagtctgtgactcgggggaaagtggaaggagaaatgcagccgatatagagtcattatgtttgcaaagcccctggtcatacaggccagggaacataagaccgcaattctaagtttctagataaacagcgatctccaagtcaagactgaggatgaagagggagaatgtcagaactcaagtgaagggcaatcagggcagactgcctggaggagtgatgccagaaggtttgggaagaaggtgtgggacaagaagaaagggtatttattcattcattcaacagaggtttatgtagggcactgtgctgggtggggctggggacacaacaatgactgaggcagcctggccttgccttcacagggctcaccatacacaagtaaataaaaaatatgtaatgtttggaattgctaaa

SEQ ID NO: 136007 - DNA, 1804 bp, Homo sapiens
  Payload ID: 6611
  Gene Symbol: GPR42
  Gene Name: G protein-coupled receptor 42 (gene/pseudogene)
  Uniprot ID: O15529
  ENST ID: ENST00000454971
  CDS Start-End: 202-1242
cccctttttgcatactgaccagccctggcaacggagctcaaggcatctttgtgccactgctcaacagtgagtgatgtcatgggcacggccaggtctttatcagttctgccggataaatagccaactgcactaggtctggagagacagcaaggtgctgtgcggcagagcatttggggtctcaaagaagcagtggccaccaccatggatacaggccccgaccagtcctacttctccggcaatcactggttcgtcttctcggtgtaccttctcactttcctggtggggctccccctcaacctgctggccctggtggtcttcgtgggcaagctgcggtgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttctggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctggtggcggccacgctgctcaacttccttgtctgctttgggccctacaacgtgtcccatgtcgtgggctatatctgcggtgaaagcccggtgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaaactaggtcctccgggggaggagggtgtagctggcgtgtcatcctcagggcgcttcctcgctcacgccaggagggacttggagtggcgagctggggcccgatggggcttgggggcagagtagacatctagcctccctaagggtatgcgcgctaaagcccagctctcgatctcacctccatccccatccacccacacactatggattgggctctgggaaggggtcagggtgagaggctgctctggagaacaatgaggtcctcatagcagcaggcagctcctgtgttttcttgagggtggcagaggagctaagagcagtgcccaggtctgagggggctgcccagtgagtggcaggggcaggagaggggagaaccccatcctcagagctgctcccagccagcgagtcaggagcgggggagacagggctccagggatgaggccgcattctgctcccacagtgccttttccagaaagttcccattgctcaataaatgtggatcatcagagacatttatgaacaatgacagaagaaaaattacccaaataaatgtggaagcaagcaaaagagaa

SEQ ID NO: 136008 - DNA, 1182 bp, Homo sapiens
  Payload ID: 6611
  Gene Symbol: GPR42
  Gene Name: G protein-coupled receptor 42 (gene/pseudogene)
  Uniprot ID: O15529
  ENST ID: ENST00000597214
  CDS Start-End: 71-1111
tgctggccagaggccgttagggcccccactaccaactccatgttactctctctcaccagtggccaccaccatggatacaggccccgaccagtcctacttctccggcaatcactggttcgtcttctcggtgtaccttctcactttcctggtggggctccccctcaacctgctggccctggtggtcttcgtgggcaagctgcggtgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttctggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctggtggcggccacgctgctcaacttccttgtctgctttgggccctacaacgtgtcccatgtcgtgggctatatctgcggtgaaagcccggtgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaaactaggtcctccgggggaggagggtgtagctggcgtgtcatcctcagggcgcttcctcgctcacgccaggagggac

SEQ ID NO: 136009 - DNA, 1307 bp, Homo sapiens
  Payload ID: 6612
  Gene Symbol: GPR45
  Gene Name: G protein-coupled receptor 45
  Uniprot ID: Q9Y5Y3
  ENST ID: ENST00000258456
  CDS Start-End: 117-1235
cagaggtccacagacatccaggaagatgcagccagcagacaaagaatggcagccacccaagtgctgaggggagccctcccggccatttctgtcccagctccaagggtctctccacgatggcctgcaacagcacgtcccttgaggcttacacatacctgctgctgaacaccagcaacgcctcagactcggggtccacccagttgcccgcacccctcaggatctccttggccatagtgatgctgctgatgaccgtggtggggttcctgggcaacactgtggtctgcatcatcgtgtaccagaggccggctatgcgctcggccatcaacctgctgctggccaccctggccttctccgacatcatgctgtccctctgctgcatgcccttcaccgccgtcaccctcatcaccgtgcgctggcactttggggaccacttctgccgcctctcagccacgctctactggttttttgtcctggagggcgtggccatcctgctcatcatcagcgtggaccgcttcctcatcatcgtccagcgccaggacaagctgaacccgcgcagggccaaggtgatcatcgcggtctcctgggtgctgtccttctgcatcgcggggccctcgctcacgggctggacgctggtggaggtgccggcgcgggccccacagtgcgtgctgggctacacggagctccccgctgaccgcgcctacgtggtcaccttggtggtggccgtgttcttcgcgccctttggcgtcatgctgtgcgcctacatgtgcatcctcaacacggtccgcaagaacgccgtgcgcgtgcacaaccagtcggacagcctggacctgcggcagctcaccagggcgggcctgcggcgcctgcagcggcagcaacaggtcagcgtggacttgagcttcaagaccaaggccttcaccaccatcctgatcctcttcgtgggcttctccctctgctggctgccccactccgtctacagcctcctgtctgtgtttagccagcgcttttactgcggttcctccttctacgccaccagcacctgcgtcctgtggctcagttacctcaagtccgtcttcaaccccatcgtctactgctggagaatcaaaaaattccgcgaggcctgcatagagttgctgccccagaccttccaaatcctccccaaagtgcctgagcggatccgaaggagaatccagccaagcacagtctacgtgtgcaatgaaaaccagtctgcggtttagggggtcagggggccacagagaaggggcagctgagccccagtcccagggtggatctgtcctgctctgttccct

SEQ ID NO: 136010 - DNA, 1951 bp, Homo sapiens
  Payload ID: 6613
  Gene Symbol: GPR50
  Gene Name: G protein-coupled receptor 50
  Uniprot ID: Q13585
  ENST ID: ENST00000218316
  CDS Start-End: 70-1923
tgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaaggctgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccaccactggccacatcaagccagctaccagccatgctgagcccaccactgctgactatcccaagcctgccactaccagccaccctaagcccactgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttattgatgttgaagatgatcctgatgaaatggctgtgtgaaaaatgctctcgtaggtggccaggcagt

SEQ ID NO: 136011 - DNA, 1848 bp, Homo sapiens
  Payload ID: 6613
  Gene Symbol: GPR50
  Gene Name: G protein-coupled receptor 50
  ENST ID: ENST00000617907
  CDS Start-End: 1-1848
atggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaaggctgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccaccactccacatcaagccagctaccaggctgagcccaccactgctgactatcccaagcctgccactaccagccaccctaagcccactgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttattgatgttgaagatgatcctgatgaaatggctgtgtga

SEQ ID NO: 136012 - DNA, 1088 bp, Homo sapiens
  Payload ID: 6614
  Gene Symbol: GPR52
  Gene Name: G protein-coupled receptor 52
  Uniprot ID: Q9Y2T5
  ENST ID: ENST00000367685
  CDS Start-End: 2-1087
catgaatgaatccaggtggactgaatggaggatcctgaacatgagcagtggcattgtgaatgtgtccgagcgtcactcctgcccacttggatttggccactacagtgtggtggatgtctgcatcttcgagacagtggttattgtgttgctgacatttctgatcattgctgggaatctaacagttatctttgtctttcattgtgctccactgttacatcattatactaccagctatttcattcagacgatggcatatgctgatcttttcgttggagttagctgcttggttcctactctgtcacttctccactactccacaggtgtccacgagtcattgacttgccaggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgtttactttatgctcctgctgcctttgttgtctgcttcacttacttccacattttcaaaatttgccgtcagcacaccaaagagataaatgaccgaagagcccgattccctagtcatgaggtagattcttccagagagactggacacagccctgaccgtcgctacgccatggttttgtttaggataaccagtgtattttatatgctgtggctcccctatataatttactttcttctagaaagctcccgggtcttggacaatccaactctgtccttcttaacaacctggcttgcaataagtaatagtttttgtaactgtgtaatatacagcctctccaacagcgttttccggctaggcctccgaagactgtctgagacaatgtgcacatcctgtatgtgtgtgaaggatcaggaagcacaagaacccaaacctaggaaacgggctaattcttgctccatttgaa

SEQ ID NO: 136013 - DNA, 1523 bp, Homo sapiens
  Payload ID: 6615
  Gene Symbol: GPR55
  Gene Name: G protein-coupled receptor 55
  Uniprot ID: Q9Y2T6
  ENST ID: ENST00000392039
  CDS Start-End: 427-1386
agaatgctctgggctttcaaaatggttacttttcggctgggcatggttttaaatggttacttttcctctcctgttgcctgaagcctggggatttttctcctgtcttcacagtgagaaactggtgaccttcctggaggtaaccccaggaaaatgtggggcttccctactacagggaccccaggactttatgacacttaagctagcccaaacactcagcctccagcaattcgtcaggtaccatgtaagtgctcctacaagttgccggctcctgggtggcttctgcttctggaagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtg

SEQ ID NO: 136014 - DNA, 3828 bp, Homo sapiens
  Payload ID: 6615
  Gene Symbol: GPR55
  Gene Name: G protein-coupled receptor 55
  Uniprot ID: Q9Y2T6
  ENST ID: ENST00000392040
  CDS Start-End: 194-1153
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttcgactgggaggttctggaaagaaagagagagagagaaaagaggtaaaggagggagccaagagagtcagttattggggagagtgtcttgggcagaggtggggtggtagggatgagtgaagtccctttttagtttgggtgtcccagaacagagcagacttgcattttccagtcccttctggaactgtgttgccaaaagcctcactgagatgacagcaagaaggggtggtgttggggctgggcaagtagcatggatcaccccaagtttccagtgagcctcagaaaggtgaaggaagccagccacacctttccgtgcccgtgagaagactgcaaaatgactgagtggggtgttgatgacatccaagagccatgaggggggagaggaaaggacacttctggggaaggaagaagacaggcccagggctggaagcacacagcccctcccctatcaccatcagggtgtccacagcacggagtgttggtgctggcccagggtgaagagagacagtgagagacggcctgggagcggggagaccccgacctgctttctatcttaaacagactgggaagttgctcattacagctagcttccttgaaaacaatggcaaagaatcaggcctgccttggttccaccataggagggtggaggaggtgctgtcttactcacctgcatcctggctgggcagctggcacccgtggcactgcccatggagccgtccctccctggcagctgggagggagatgaggcagctaggcacaagggtgtggccttgagaaagaaggcaagggggggtccctgctggtcccaggaaactgtaaacaattgagtcacgcctggatggcttctcaacggatctggaggaggagtgcaagtgacagcggaagcctcccaatgactcagctgctccggagagtgaaatgatgagaaggatccattgtggggtggttttgcatgacagagcgagtgggatgaggagtaactgatgagacttcatgtgagcaaggtcttcaggaggaaaagcaactgaggtctacttgtaggatctgggctcagtgggggctgaagggcttgggaggggtggtgacctgaggggaagaagagaagcatttggataaacctggacctgtggggaggaggaggaggaagaggaagaggaaaaggaggggaagctgagccgtggccctaggcttgaagcctgcagggagtgcagggtgggtggggaacctggctgagctgcttcctgcctgagagctttcccagctggcctaagagccatggacggacaggagtcgccttctcaggagcagctcccgctgttgctgtgttcaagtggcaccctgtacacctcctcctaggtggatggagggaagggtgaggaagagagcgtcaatgaaggggtggaagtggatgtggaggagtgaccagaccagaccagaccagaccagagggatcggaggctcaggccccctgagctgggcctctaagaaccacagccacagagtcaggctctgcagacccagaggtaaggctgcctggctgccccaaaccccagacactcctctccttgcctgcaggctgccctctcccatggccaccctagacagagacccacccgtgatactctgagggagccagactttcacatgcaacggggcatttggggctggttcgggtcagtgtctacgggtggtggatttagtgaccaccctcctcccacttctttctctgcacgaggagttgggagcctgcctggtggagttgagtgatgcccgtcatgtgcacttgggtctaccaatgtgcttaaggccagatgggcttcctaagagacaagggtgggtggacctaaccaactatcatccccagcgatgttcaaacataaaatcttatctatgtgcagcatgactctctccaggtgacagaaagggctctagacagctgagaggacctgatcatgtagggagggacggggaggggagccaggacccaggagctgcatggctgtaagaggaaggtccttggagggtatcagcagtctcagtgtgatgtgacaactatggacctgtgggtgtgccctggggacccctgacccatcccaaaacactgtggaaagaagggcctcttctccgtggggacccgtgtctgtgggagcgggcacaggtccatgctgcaggccactacggctgctcggcaggagggccgagagtttggacccacatagctgcaacccaagctggcccataatcagcagtggggcccagcagcacaggaggggcggacggttagctttggaaaaaatgacttgattaatctgattcgccaaataaatagattcatgtga

SEQ ID NO: 136015 - DNA, 2527 bp, Homo sapiens
  Payload ID: 6615
  Gene Symbol: GPR55
  Gene Name: G protein-coupled receptor 55
  Uniprot ID: Q9Y2T6
  ENST ID: ENST00000444078
  CDS Start-End: 194-1153
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttcgactgggaggttctggaaagaaagagagagagagaaaagaggtggatggagggaagggtgaggaagagagcgtcaatgaaggggtggaagtggatgtggaggagtgaccagaccagaccagaccagaccagagggatcggaggctcaggccccctgagctgggcctctaagaaccacagccacagagtcaggctctgcagacccagaggtaaggctgcctggctgccccaaaccccagacactcctctccttgcctgcaggctgccctctcccatggccaccctagacagagacccacccgtgatactctgagggagccagactttcacatgcaacggggcatttggggctggttcgggtcagtgtctacgggtggtggatttagtgaccaccctcctcccacttctttctctgcacgaggagttgggagcctgcctggtggagttgagtgatgcccgtcatgtgcacttgggtctaccaatgtgcttaaggccagatgggcttcctaagagacaagggtgggtggacctaaccaactatcatccccagcgatgttcaaacataaaatcttatctatgtgcagcatgactctctccaggtgacagaaagggctctagacagctgagaggacctgatcatgtagggagggacggggaggggagccaggacccaggagctgcatggctgtaagaggaaggtccttggagggtatcagcagtctcagtgtgatgtgacaactatggacctgtgggtgtgccctggggacccctgacccatcccaaaacactgtggaaagaagggcctcttctccgtggggacccgtgtctgtgggagcgggcacaggtccatgctgcaggccactacggctgctcggcaggagggccgagagtttggacccacatagctgcaacccaagctggcccataatcagcagtggggcccagcagcacaggaggggcggacggttagctttggaaaaaatgacttgattaatctgattcgccaaataaatagattcatgtgatgccttgtga

SEQ ID NO: 136016 - DNA, 919 bp, Homo sapiens
  Payload ID: 6615
  Gene Symbol: GPR55
  Gene Name: G protein-coupled receptor 55
  ENST ID: ENST00000438398
  CDS Start-End: 194-919
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtc

SEQ ID NO: 136017 - DNA, 2526 bp, Homo sapiens
  Payload ID: 6615
  Gene Symbol: GPR55
  Gene Name: G protein-coupled receptor 55
  Uniprot ID: Q9Y2T6
  ENST ID: ENST00000622008
  CDS Start-End: 194-1153
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttcgactgggaggttctggaaagaaagagagagagagaaaagaggtggatggagggaagggtgaggaagagagcgtcaatgaaggggtggaagtggatgtggaggagtgaccagaccagaccagaccagaccagagggatcggaggctcaggccccctgagctgggcctctaagaaccacagccacagagtcaggctctgcagacccagaggtaaggctgcctggctgccccaaaccccagacactcctctccttgcctgcaggctgccctctcccatggccaccctagacagagacccacccgtgatactctgagggagccagactttcacatgcaacggggcatttggggctggttcgggtcagtgtctacgggtggtggatttagtgaccaccctcctcccacttctttctctgcacgaggagttgggagcctgcctggtggagttgagtgatgcccgtcatgtgcacttgggtctaccaatgtgcttaaggccagatgggcttcctaagagacaagggtgggtggacctaaccaactatcatccccagcgatgttcaaacataaaatcttatctatgtgcagcatgactctctccaggtgacagaaagggctctagacagctgagaggacctgatcatgtagggagggacggggaggggagccaggacccaggagctgcatggctgtaagaggaaggtccttggagggtatcagcagtctcagtgtgatgtgacaactatggacctgtgggtgtgccctggggacccctgacccatcccaaaacactgtggaaagaagggcctcttctccgtggggacccgtgtctgtgggagcgggcacaggtccatgctgcaggccactacggctgctcggcaggagggccgagagtttggacccacatagctgcaacccaagctggcccataatcagcagtggggcccagcagcacaggaggggcggacggttagctttggaaaaaatgacttgattaatctgattcgccaaataaatagattcatgtgatgccttgtg

SEQ ID NO: 136018 - DNA, 1089 bp, Homo sapiens
  Payload ID: 6616
  Gene Symbol: GPR6
  Gene Name: G protein-coupled receptor 6
  Uniprot ID: P46095
  ENST ID: ENST00000275169
  CDS Start-End: 1-1089
atgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctga

SEQ ID NO: 136019 - DNA, 1945 bp, Homo sapiens
  Payload ID: 6616
  Gene Symbol: GPR6
  Gene Name: G protein-coupled receptor 6
  Uniprot ID: P46095
  ENST ID: ENST00000414000
  CDS Start-End: 295-1428
aatctgcagcgcgcgccgctcgcagccgccttttctgccaccaactgtatctctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccagcaccgcggacagcgtctctgctgcccagccccatggggatgtcctggtcgcgccgccacaacccaggcgggactctcccaggatgacactcctagcttggtgcactcggggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggtaagctcggtgcctgctgacgaactctgagatcccaatggtgtgagtctgactttggaaagaaaaagggactaaagagaaatgtaacaaacttacaaggacaaagaggcttgttggcactttacatatacagtgtatacatgtgtacatatatatacaaatatttgtatcttctggaggtgttcaggatgtggagcttcctattctgtgaaaaaccaagaaaaagatatggttgtatactcaaattgtacatcacgtttgtcaaacgaagacattccaatactgcttaattatagcactttatttttagctgctgaactgccaaaacagtgttgccattttcaagggcagggaaaagggagtaaaaggtgtatttttgtcgtatgtgatagaatattttgctgcacatgcatcaacaaattacaacatgttttgtacacgaataaacccattacaagaatgt

SEQ ID NO: 136020 - DNA, 2834 bp, Homo sapiens
  Payload ID: 6617
  Gene Symbol: GPR61
  Gene Name: G protein-coupled receptor 61
  Uniprot ID: Q9BZJ8
  ENST ID: ENST00000404129
  CDS Start-End: 684-2039
gcagtgcttcaggcttcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaaggttatactgata

SEQ ID NO: 136021 - DNA, 4921 bp, Homo sapiens
  Payload ID: 6617
  Gene Symbol: GPR61
  Gene Name: G protein-coupled receptor 61
  Uniprot ID: Q9BZJ8
  ENST ID: ENST00000527748
  CDS Start-End: 684-2039
gcagtgcttcaggcttcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggtgaggtgaaacctctcaattggtgaaatttccatgcttccagaagcagggaattctctaagggtaggagttggaggatacagggcagcaggccaggtttggagttattctaggggccatttaggatattttatttttcagtgtaattgtccagggcagtaattgcacccaagcaaggtaagaaaatgacccatgttttctcatttccttgctaggtttaaaaagaactaaattatagccaagtgtttccacttgagttaatagatcatttttctggttttatacctgagatttccttaaaatgagaggaccagtagggtgtattcctttactgagtttggccagaaacaaggcaaaatagaaattagggtacatggagtagaagataggaaagctgactgcagctctctctctcccacccttcaggaaaagcccttctgttctatttttctgtctctctcctgcacacaggagatcaagggtagagcctgatcttagcagagacaagaataaggcaggatggctttcctctcttttaggaggaagaattagaatgactgggggtcagacgggcgagggtggaggttagcatttgaattggtaaagtagctggaaacagagaggccaggtaatcagcctgatcaataatactgcgaatcttttctttccaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaaggttatactgataacaacattgactcctttagttcaattcagtgcataatagttgaacacccactagtccctgggacccacacagggcgtgtggtcattgcttttaaggagttcatagtctaagttgatgagataccttatattttcacaaagcactttgatttgataaagcactacagaatgtgcttgagaaatatattggagaatatgtccatggctctaacttctgagagttcagcccgtggcagcaagatgcataccttgaagcttcctgcagattgtggaaagcataggggttgtaaatgaaactctctaatgaagaaaaaaaattaaatgaaactgggcaaacagctttccccctttgttctaggaaaatttctaggttgtcttcctaccactagattattataccagtctagtgcctattacattgtggaagttccctaaaaacatagtatatatagggaggagagtcctttgtgattgaaaaacatgttcacctctcctccctattaaaataaatgcatacagaggaatcaatcattcctagacagggaaaaaactcttctttcaaacaccactgatcagctattagatccaaggaattgccagcaggtggcagtgtgagcccaatggaaggaggaaaggcgagtgtacgtggtgggaggaggaaggggagggcattaaacattgcctggcagccattttgttaatttattttgccttttcctttgactttgccctccagcccttccttcacatacatcaaagaagaaagttttaagagcaagggtatctttaattcaggctgaaatttcctgacactgtgatctcactggtgtttattacagagtttgacatacatgggttcatttgccatttatttttccctgtaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtcagttactttttcctgcatcctgctggtgttggggtaactcccaatcctagatgaaaaccttagactttctgttgtcaggtgtccccaggcaatatcctacgggggcatgatagaaaagggtaactctggggtcagatagatgtacttactcactgtgtgaagttgggaaagctgcttaatttctctgagcctacttcctcacctgtaaaaatggggatcattattacctacctcacagggttgttgtgaggattaagagatgggatgtgggagcacctagccgtatctggcaaataggtactcaataaatactggttttacttcc

SEQ ID NO: 136022 - DNA, 2557 bp, Homo sapiens
  Payload ID: 6617
  Gene Symbol: GPR61
  Gene Name: G protein-coupled receptor 61
  Uniprot ID: Q9BZJ8
  ENST ID: ENST00000469383
  CDS Start-End: 635-1990
ctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtagccgaaaggtaaatgaggc

SEQ ID NO: 136023 - DNA, 2459 bp, Homo sapiens
  Payload ID: 6617
  Gene Symbol: GPR61
  Gene Name: G protein-coupled receptor 61
  Uniprot ID: Q9BZJ8
  ENST ID: ENST00000616874
  CDS Start-End: 320-1675
tcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaagg

SEQ ID NO: 136024 - DNA, 2823 bp, Homo sapiens
  Payload ID: 6617
  Gene Symbol: GPR61
  Gene Name: G protein-coupled receptor 61
  Uniprot ID: Q9BZJ8
  ENST ID: ENST00000618721
  CDS Start-End: 684-2039
gcagtgcttcaggcttcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaagg

SEQ ID NO: 136025 - DNA, 2191 bp, Homo sapiens
  Payload ID: 6618
  Gene Symbol: GPR62
  Gene Name: G protein-coupled receptor 62
  Uniprot ID: Q9BZJ7
  ENST ID: ENST00000322241
  CDS Start-End: 340-1446
cagggggctggcgccaggccctgcccctcccttgccagccgtgtgtggcaacatcagagtgacagccagtaccatctccgacaggggctgagttgctggagctgggctggggcaggggagaaagacagcagactcatccttgcacccctccatgggcctggccaagcccccaagaggatggcagcctgggcgtcggagccacctcctgggcagccaatgaggtgaggggccggaggagcaagggacaagaggagcagaggacaggtgatggaaatcctgcagctttaggctccattctgccatctacatcccagcgcagggtgaagcctgagagcccaaatggccaactccacagggctgaacgcctcagaagtcgcaggctcgttggggttgatcctggcagctgtcgtggaggtgggggcactgctgggcaacggcgcgctgctggtcgtggtgctgcgcacgccgggactgcgcgacgcgctctacctggcgcacctgtgcgtcgtggacctgctggcggccgcctccatcatgccgctgggcctgctggccgcaccgccgcccgggctgggccgcgtgcgcctgggccccgcgccatgccgcgccgctcgcttcctctccgccgctctgctgccggcctgcacgctcggggtggccgcacttggcctggcacgctaccgcctcatcgtgcacccgctgcggccaggctcgcggccgccgcctgtgctcgtgctcaccgccgtgtgggccgcggcgggactgctgggcgcgctctccctgctcggcacgccgcccgcaccgccccctgctcctgctcgctgctcggtcctggctgggggcctcgggcccttccggccgctctgggccctgctggccttcgcgctgcccgccctcctgctgctcggcgcctacggcggcatcttcgtggtggcgcgtcgcgctgccctgaggcccccacggccggcgcgcgggtcccgactccactcggactctctggatagccgcctttccatcttgccgccgctccggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctgggtcgcctactcggccttcgcggctcaccccttcctgtacgggctgctgcagcgccccgtgcgcttggcactgggccgcctctctcgccgtgcactgcctggacctgtgcgggcctgcactccgcaagcctggcacccgcgggcactcttgcaatgcctccagagacccccagagggccctgccgtaggcccttctgaggctccagaacagacccccgagttggcaggagggcggagccccgcataccaggggccacctgagagttctctctcctgagcaggagaaaggagggtggtttccgtgggggctcatccaacccctgcacaggtcacagcaggtgccctgctggatatctgggtctggaacaggaggagaaagggtgtctgctgcctggtgaggcccacggacttctgagagccaggaatcctgcggtctgggcccaacactgcatagcactgtgcataggccgacccttccttaggcctcagctttcccatctgcaccctgcagcatctctaagggcccctccagcataggtggtttgtgaaactcacaggtggtccccaggccaagatgggcaggtgtcacaaagaagagggccctaagggctcacaaccaaagtgatccgccaagcagggcagtatctgggttacagccacagcaggaagaaccactggagagacactcagaaggacttccctgacatctgcaccaaggagagtctggacaaagctactgaaactcctccacctgcttctaaaatgcccagaagacaactggaccagtttggtattagaagtaggaggctggacgacttcacccccaaagggtcctgaagccccagaactggcatgtggaaggggctgaggcctaattgaggttggtggattcacacatgggggtcctccaggacctcagctgcacccattttctggaggttttgctgcccacaacaccagtatttcacaacttcctggtcgctgagaatatttattcaaaaacagggattgaaaaaactgta

SEQ ID NO: 136026 - DNA, 5952 bp, Homo sapiens
  Payload ID: 6619
  Gene Symbol: GPR63
  Gene Name: G protein-coupled receptor 63
  Uniprot ID: Q9BZJ6
  ENST ID: ENST00000229955
  CDS Start-End: 347-1606
ctcccgccaccgccgcctgtatcgccgccgccgccaccacctcctcttcgttgtcctccttcctcctccgcctggcagcgttgttctctgcagcggaggagagaagtgctatgtcaggaaagttccgggagggactacatggagccatgctccctgggctcttccgcgggcgcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccatggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtgaatattggaactggctgacattttgggtgatgcttgttctttattgacattgaattctctttctcatagcctctccactttatttttttttatagggtttgtgtatgtatgtgtgtgagcagtgtaaagaaagaatggtaattatagttctgttaccaagaataaataataggaaagtgattacaaatattacctccagggttcaatagaaatcctcaatttagggtgaggagacttttttttggttttggggtttttccttgattgattttgttttcatagtgggaatcaggattgtgctttattgagcctgcagttacattgaattgtaggtgtttcgtgtgctgctaaggtatgcttatttgagtttatcaagactttttttttctggaagacactgctgcttttaccatcacattggagccaaacatctcaatcaatatatatttagttttattttaaaaactaacccaggaaggttagcgacattttaagggtcattactatttactttggtgcactttaagagataatgtacaaattaattcagtcttatttttcagaattgtttttatacatgatatgtgctttaggaaatgtgcattatcatttatgggaagatagttttaagaaatgttttatctgcatgtacagttgtaaaagagaacataaaatgtagatacttttctaagcacaatagcaactcttcaagcaatagcgcaaaatctaggagacaggatccttgcaaatttaaaaggtgaatgtagtgagggggatggcaagtggctggtacaggctgtggtgattccttttactcaagggtttttgtggagtatagggagaaggggttgatatttatggacacctatgtgtcaggcactgtgcatcattttatccttacaggatgttgtgaggtaggtattattgttttcatttttacaggtgaagaaagcaggtctcagagggactaaaatcctgcccaaggttagtggtagagctgggatccaaaaatctgtcagaatcctgagactgcgctgttccactgtgccacgcagacagttcattcagtttagatgtcacatagtcaagagggaactctatgcatcctttaattttttagactatgatattctttttaaaaattagcctttattttctaactaccaaaagaaatatgaaagcattacagaaacactggaaaatagaaaagaaaaaataaaatcacttacaaccactttttgttttttggagtctcgctttgccacccaggctggagtgcagtggtgtgatcatggctcattgtagcctcaacctcccaggctcaggtaatcctcctgtctcagcctcctgaatagctggaaccacacacacacacgcacacacaggtgtgtgccaccacacccagctatttttttgtattttcttttgtaaagacaaggtttcaccatgttgcccaggctggtctcagagtcctgagctcaaacgatctgcctgccttggcctcccaaaatgttgggattacaggcatgagccaccacatctgacctacaaccactttttaatgtgagacttaaaaatcttagataaataaggctgtgaagcaaaaccagtgatttttttttttgtttttgatttgcaaaacaagtgactgacaattattgagaaattaaagatagctatgtgtaggtcttgcccctgcgggtttggaggtttccagttgtccatctgtgttagttgtaagtgttctgggcagaatagtattgttgccccaatgcttgccctagcagagctggagtttgtgaacgtgctcagatgtgtgtctcctacaaagaagggaaaatgaaccctcgtctgagcctagaacaagttttaatagggcatgtctgacatttcaaattgtttttctcttgctgacagtctgcccccaggtgcatctagggccttggtcagcttctctgttaccagtggctcactttataaaacagcccacagggataagggctgaaaatatagccacttggctacatcattgactaattaagtaagttaactgtggatttatagcatcttttcaggatgttagtgttttgtgagccagtggaaaaaataagcttctatttcttcatttgtaaaaccagagagttggattagatgaatctctaacgtcctgtccagctcaaatgtgctttcctctatactagggtatagatttttgaagagcctagctgacttcagcatcacctcaccctttggtctccagtattacttctttacattttacttcattagctatttcttaatattaaatgtctgaagagtgtggcactgtatcaggagttggggcattgaaaggttgaagacatcatgaaatatctgggaaactctgctcttaaggaaattgcaccgatgttggaactcattgtccagttaaagagctctttggggactcaagcatattattcaacatgttgttttgggattatcttcaaatgatagtcacctacctctttcatttctaatttttattcacaggtaaaattgtttttgtccatagggattttataggacataagcactgtagtagatactagtagcattttgaagtgtattatgctctccattttccatataaactagatttcaagcagatattgataaggacattttttattagacttttctctgaggaaagtcagcatgatctgtattcatcttacatattgataggtcatgaagactcctttttggctggaggtgaaactgagctttgttttctttgttcctgttttatgggcagtctttaggtactttcatgctgcttaataggcagtgcctcatttggtgagagctctggagtgcctgccgagacgctccctgtttgtgaacaaagattatgaaggggtctttgtgagaattcagcagcaacactgaacagcagttctttttacactggattatcttgatctgatgagagtttacaaatcattttgaacatttttattatgtatacattgtgaaagctttaaaaataagtactatggagcacctttgagaaacgtaggtgcaaaatcatatgttgcctattcccccatattttcttgaggcagggaaagataccactactaattctcactgcttacaggcataatcagaaatggttttttgtttgcctgtttttccttctggctagtaagaagcgtaaaagagataatgaaatatttgtggtcaaaagaaagatgcaagggaaattccaaatagtatggagtaacattatttaaactttaatacatgtttaagcatccccaagggagcttgttaacagtacagattcctgggcctccagagggtctgtggttgagcccaggaatgtgcatttttattttattgagcactctgcctgactctggctcaggtagtccctgggaaactcttcaggaaacattcctgtagaaaatatatctatttaaatatcatctgttttatcccacaatgtttgtttcgtgttgcaagccattatcttctaggcatgggtaatccacattgagaggaaaatccacacaacattgtgcctgatttgctgccacctgtgtttgtgctggatcttgccagtgttagctttattttctttcaactggcaaaattctgataaagcatatagcttcacagtagagcaaaatgggtgacttaattgaaagtcatgactttcagcagtctaattatgctcatattttattttcttatagagagctgtctttattgtgtgtaattcccggaagaatgtaaagatttatctaattcctattgctctgccagttgtgttcaatgcaagcattgaagtaaaataaaaataacctttttaatatgtgtatttctgttgcccacaaagatatttaatttttttcttgatctttgtttttgtttatgtgaaaatatttacatatgtatcatttctgtatatatcacagaaaagttttcacttgcttgacattttattctacaatgatttttagtttaagtttaaagaatggctacattcagatttattttcacaactatagtcctgctaaactgccttcattgaaaactcagtttttatgataaaaaatatcaaagcacaagtttgttattggaggtaaattatacatttcttagatatctattggtactagacctttgtaattaaaattaatttattttacaatagtaactgacctgtatggaaaaaaaaacaaccttgaattatgggttctaatatttaaatatcgaaaaatatggttatttgtgcatattcttattacaaccaagaaaagaactcctgataagaaaataaataaatatttaacattt

SEQ ID NO: 136027 - DNA, 4522 bp, Homo sapiens
  Payload ID: 6620
  Gene Symbol: GPR65
  Gene Name: G protein-coupled receptor 65
  Uniprot ID: Q8IYL9
  ENST ID: ENST00000267549
  CDS Start-End: 559-1572
cctgtcccctcagcagtgttggtttctcttcttgacttgatgcaggcacagatttatcaagctcctcagtcaacaaacacatcaccggaagaaatatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatgaacagcacatgtattgaagaacagcatgacctggatcactatttgtttcccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacctggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaatcataaaactacttgtcagcatcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgtaaccgaaacaggaagatatgatatgtggaatatattaaaattctgcactgggaggtgtaatacatcacaaagacaaagaaaacgcatactttctgtgtctacaaaagatactatggaattagaggtccttgagtagaaccaaggatgttttgaagggaagggaagtttaagttatgcattattatatcatcaagattacattttgaaaaggaaatctagcatgtgaggggactaagtgttctcagagtgatgttttaatccagtccaataaaaatatcttaaaactgcattgtacagctccctccctgcgttttattaaatgatgtatattaaacaaagatcaatattttcttaatgactcagggtctttattgttaatgccaattgtttttgtatctgtgctataatcccttagagtcagtaaagtatgtaggggactgtttcttcctttgtgtctgggtttatgatttttctcactctttctttggactccagggtgtcagccatcaggtctcctaattttgtgtaccggtctccaacaaccccagctactgaatactgcttctaatctcctcattcattaacaaatctttatttttttatcttgtataaaataactgctttattgacacaaaatttacataacttaaaattcaactttgtattgtgtacaattcagtgattttttgtatattcacagagctgtgcaaccatcaccacactcaaaaaattttcatcacccaccaaagaaatcttatactcttagcagtcgctccctgctctcccgtccatgccagttattaatttactttctgtctctaaggattttcattactctgaacatttcatataaatagaattatacaatatgtggcctactgtgacgtatttcacttagtataatggtttcaagttttatccatgtgtagaatgtatcagcacttcatttctttttatggcctgatagtattctgttgcatggttatactccattttgtttatctaatcacttggcttcattaacaaatatttattgaatccattccataaactaggttttgagttaagtactggggctatgaaagaaatggtctcatgaagcctcacgaagtttacattagttcaaaagcctagtcaccgagcttgaaagatttctatataaaggaaaaggaaataggctctgagttttattttgatctctttttaatttataactgggtataacatagctgaaattaccagaagtttaatgcatagacaaataaatagttctattatatctttctttttggacttagaatgttagaatattttgagagttctttttttttttttttttgagtcagagtcttgctctgtaatccaggctagagtgtagtggtgcgatctccactcactgcagcctccacctcccaggttcaagcgattctcctgcctcagcctcccaagtagctgggattacaggcacccaccaccatgcccagctaatttttgtatttttagtagagacggggtttcaccatgttgcacaggctggtctcaatcgaactcctgacctcaagtgatcatcccacctaggtctcccaaagtgctgagatgacaggcgtgagccaccatgcctggcaaagagagtcttgatacaacatattcttttgaatcctcattgtgtaaattgcctcgttgtaaatagacactcagtaaacattttcctcaccaaaatatttttaaggatttttctacccttctccttttctctttgctttccttttcttgcctgttctttccactccccccaaaatgatcagatagcaaatgtcttgataacatgaggtgccctcacattaaaaaacaaaatattgagccgggcgcggtggctcatgcctgtaatcccagcactttgggaggctgaggtgggcagatcgccttaggtcaggagttggagaccaggctgaccaatatgatgaaactctgtctctactaaaaattcaaaaatgtgccagacctggcctggtggcatgtgcctgtaatcccagctacttgggaggctgagtcataagcctgcaatgggaaaatggatcgaatctggggtgagggggaagtgatgtgggggttatggtacctcttttctcttccaaagatgctgttcttactgcatcacttgtggctggccaggaaaagccatgcaggagttttgtttgtggccactaggtgacgatcgtgttctgtacgggacctcttattaatagttcaccactagccgccactccagaagagcggaggaacccaggataatattttgtcaaccaagaaacaagaagtccctcccaggaactggaaatgaatggggaaaatgctgaaatctcatttgcactattcatttctcttctctctggaaagctcggcaatcatcaggtcatttcatttggcttaaattccatgtgtctttccaaacttttaaaagctggtgaaaattgttccacccatatgtaaaagaacataggttaagttgtctaattcttgcaggaatgtggatatagcattaaaaatatgtctttgtatacttatcttacccatgtaagaaaagagtggccaactttcatataaatagaaagagaacatttaagctatatgcagtttgcatttttgtctactattatgaaattattatctatgaaattcaagctgtaactcaacatatgtataattttaatttctaatttattgttagatctcagcacttaaaaaattacatcttgtatttgaattgttaaatctgttccctgcaaagaacagtaatacaatcatgttctaatttactagcatttgcatattttagaaatataatggcctgtaatttacttttcttttgcctataattttctgaagctctttatgatgcaccggtgcatttttatttaaaaaatagattgtgactcctcaaataatgttacaattcgatgttcaaaaagcaatccaggtacatagccataaagggatgagctagagaggtctccatattatcattcaatgtgagaataaaaattctatattttattctagaataaaattataaatttctttatcta

SEQ ID NO: 136028 - DNA, 1355 bp, Homo sapiens
  Payload ID: 6621
  Gene Symbol: GPR68
  Gene Name: G protein-coupled receptor 68
  ENST ID: ENST00000529102
  CDS Start-End: 342-1355
gctcctcacctggttgcagagaccacactgccttcctggggccctgaggctctaggagaagctggaaagcacaggtgggggtccatccagctgtttccaaactgcgggttgtgacccattcatgggtcagtaaatcaacttcatagctcatgacctgcatttaaaaaattgaaatagaatagaaatgatcagagtgcgtggcaagaagtaggggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagccc

SEQ ID NO: 136029 - DNA, 2859 bp, Homo sapiens
  Payload ID: 6621
  Gene Symbol: GPR68
  Gene Name: G protein-coupled receptor 68
  Uniprot ID: Q15743
  ENST ID: ENST00000531499
  CDS Start-End: 341-1438
gtcagcgtgaaaggcagggcatggaccctcactcagggctgcgtgtgcccgacgtgggtggggggggcgtggaatcggagcacaacttggccctgcgttcccaggaagggacccgaagacctccccaggccaccccgccatctgcgtgcgcgctggcaagaggaggggcgcggggtaatggtggccggcgccacagccccgcgccgcgcagggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctagcctgggtcctccgcgggtggctccacgtgaggcctgagccttcagcccacgggcctcagggcctgccgcctcctgcttccctcgctgcggaggcagggaagcccctgtaactccggaagcctgctctcgcttgctgagcccgctgggaccgccgagggtgggaataagccccggttggctcgtgggaataagccgtgtcctctgccgcggctgcgatgtggccaggctggggctgctggtcgggggaagacagtgaactgcgttccctggcctgcttcctgcagagtttgtgcatggggagtgtgaggacatggagggtgggaggctgggcgttcagctgccagggccttccaatgccaccgttgtcacagacaatgcctgtccaaacgtcccggtgggatcagcactgcagcccgcccacaacagggtgggaagggaagactggagggggaaggaaggcaggagggggaaggaagaaagagggggaaggaaagaaagaggggggaaggaaaggaggaaggggagaaggaagggaggaggaaagaaggaaggtagggggtgttgggttgggagaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactgga

SEQ ID NO: 136030 - DNA, 2859 bp, Homo sapiens
  Payload ID: 6621
  Gene Symbol: GPR68
  Gene Name: G protein-coupled receptor 68
  Uniprot ID: Q15743
  ENST ID: ENST00000535815
  CDS Start-End: 342-1439
gctcctcacctggttgcagagaccacactgccttcctggggccctgaggctctaggagaagctggaaagcacaggtgggggtccatccagctgtttccaaactgcgggttgtgacccattcatgggtcagtaaatcaacttcatagctcatgacctgcatttaaaaaattgaaatagaatagaaatgatcagagtgcgtggcaagaagtaggggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctagcctgggtcctccgcgggtggctccacgtgaggcctgagccttcagcccacgggcctcagggcctgccgcctcctgcttccctcgctgcggaggcagggaagcccctgtaactccggaagcctgctctcgcttgctgagcccgctgggaccgccgagggtgggaataagccccggttggctcgtgggaataagccgtgtcctctgccgcggctgcgatgtggccaggctggggctgctggtcgggggaagacagtgaactgcgttccctggcctgcttcctgcagagtttgtgcatggggagtgtgaggacatggagggtgggaggctgggcgttcagctgccagggccttccaatgccaccgttgtcacagacaatgcctgtccaaacgtcccggtgggatcagcactgcagcccgcccacaacagggtgggaagggaagactggagggggaaggaaggcaggagggggaaggaagaaagagggggaaggaaagaaagaggggggaaggaaaggaggaaggggagaaggaagggaggaggaaagaaggaaggtagggggtgttgggttgggagaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactgg

SEQ ID NO: 136031 - DNA, 2115 bp, Homo sapiens
  Payload ID: 6622
  Gene Symbol: GPR75
  Gene Name: G protein-coupled receptor 75
  Uniprot ID: O95800
  ENST ID: ENST00000394705
  CDS Start-End: 272-1894
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 136032 - DNA, 1694 bp, Homo sapiens
  Payload ID: 6623
  Gene Symbol: GPR78
  Gene Name: G protein-coupled receptor 78
  Uniprot ID: Q96P69
  ENST ID: ENST00000382487
  CDS Start-End: 418-1509
agaagcgcgcagagtcccatcctgccacgccacgaggagagaagaaggaaagatacagtgttaggaaagagacctccctcgcccctacgccccgcgcccctgcgcctcgcttcagcctcaggacagtcctgccgggacggtgagcgcattcagcaccctggacagcaccgcggttgcgctgcctccagggcggccccgggctgctcctgctccgcagagctacgccctccccccgggtgccccggaccctgcacttgccgccgctttcctcgcgctgctctggaccttgctagccggctctgcacctcccagaagccgtgggcgcgccgctcagctgctccatcgcctcactttcccaggctcgcgcccgaagcagagccatgagaaccccagggtgcctggcgagccgctagcgccatgggccccggcgaggcgctgctggcgggtctcctggtgatggtactggccgtggcgctgctatccaacgcactggtgctgctttgttgcgcctacagcgctgagctccgcactcgagcctcaggcgtcctcctggtgaatctgtctctgggccacctgctgctggcggcgctggacatgcccttcacgctgctcggtgtgatgcgcgggcggacaccgtcggcgcccggcgcatgccaagtcattggcttcctggacaccttcctggcgtccaacgcggcgctgagcgtggcggcgctgagcgcagaccagtggctggcagtgggcttcccactgcgctacgccggacgcctgcgaccgcgctatgccggcctgctgctgggctgtgcctggggacagtcgctggccttctcaggcgctgcacttggctgctcgtggcttggctacagcagcgccttcgcgtcctgttcgctgcgcctgccgcccgagcctgagcgtccgcgcttcgcagccttcaccgccacgctccatgccgtgggcttcgtgctgccgctggcggtgctctgcctcacctcgctccaggtgcaccgggtggcacgcagacactgccagcgcatggacaccgtcaccatgaaggcgctcgcgctgctcgccgacctgcaccccagtgtgcggcagcgctgcctcatccagcagaagcggcgccgccaccgcgccaccaggaagattggcattgctattgcgaccttcctcatctgctttgccccgtatgtcatgaccaggctggcggagctcgtgcccttcgtcaccgtgaacgcccagtggggcatcctcagcaagtgcctgacctacagcaaggcggtggccgacccgttcacgtactctctgctccgccggccgttccgccaagtcctggccggcatggtgcaccggctgctgaagagaaccccgcgcccagcatccacccatgacagctctctggatgtggccggcatggtgcaccagctgctgaagagaaccccgcgcccagcgtccacccacaacggctctgtggacacagagaatgattcctgcctgcagcagacacactgagggcctggcagggctcatcgcccccaccttctaagaagccctgtggaaagggcactggccctgccacagagatgccactggggacccccagacaccagtggcttgactttgagctaaggctgaagtacaggaggaggaggaggagagggccggatgtgggtgtggacagcagtagtggcggagga

SEQ ID NO: 136033 - DNA, 4944 bp, Homo sapiens
  Payload ID: 6623
  Gene Symbol: GPR78
  Gene Name: G protein-coupled receptor 78
  ENST ID: ENST00000514302
  CDS Start-End: 2053-2838
gaactaatcctgaactttatcattgcaatgcgtatctcagcaagaatgggcaggattgcatagttaggagtactgccttactttttaaagaagtggtgaaaatatttaatattttcatatactttttctttttggaagataaaaggattaggtccagcatttcaccctacagaggatttaaatttttcatcaggaatgagatttgagtgtaagaagatgaaacgatattatactgataagaccacagggttcaaaaccaccccctacaacccagggaaggggggcagccaggctggcaagatctgaggccagaagcactggggctttggggagagcagcaaacagaacagatctagacctatcaaggtgccctcaccagagtccagagatctcaccacacacattttctcattcatgcagttgtccagtacatccttgcagatgagcaaatggcctgcctttcataatacaggctggtggagcttccccatgctcatgtctcagaagagatgctctctgctcccctgcaagtggaattgtctccctttggagtagttgagaggtgacagaggctgctgtgagtggctagaccaaagtctccctgtgaagccacgtgatgactccaccgctccccagagctgcacatggtcgctcagaagccttggaggggttgggggaggcccctgctctcaagcccccactatcacaatcactttgtcccagctattcacctgcaaacttgcttgatctgcagaagctgcagagtggcccactcttcctggacatgtcaggaaaactttgacgtggctgctctagcttcagggaaggtctaatttggtgaaaatttgaaagcaggtttgtgggagtgccagggagaaatggggagagagaaagcctctgtatttgatggatggcaatggcttggagctggtgtgatggcctctctggatgacaaggacattggacttagagccagaaggactgagtggccacgaatggattagaagattcccactgggtgagaaggctcagaagccaccacagaggatggcggaggtgggagaggcctcgcaccgcggggctccaggagccaggtgaaggacaggcatttctgtatggcacccagttctgggtgggtcctcccaaggtgcccccttctttgtctctccctctgttgcttttctctcctcttccctcttcttccccccacttcctcttcactttttcttcactttttcttcttcttctctttccttcccccatgcctttctcaaccttgtttccacttcttgtcgctcttcttgcttcaacaaacgtcgatgcagtcacagttcctgggctgaggctgggggatgggaggaagtcctgagggcagcccccgcccccttccccgccccgtcactccctctgccccgcctgcacagcttcttgccaattcattcccgcccctaccgcccctataagccaccaggtcgctccagtttggtgccagcgcctggagggagaggcgtggcgagggctgtgctgcctaggatccactgagtggctcttgctggcgtgtcagctgcgcgcgaaccagggctgggaggctcggctggaggtgtgaccagggcagggactgacctggcccggaacagaagcgcgcagagtcccatcctgccacgccacgaggagagaagaaggaaagatacagtgttaggaaagagacctccctcgcccctacgccccgcgcccctgcgcctcgcttcagcctcaggacagtcctgccgggacggtgagcgcattcagcaccctggacagcaccgcggttgcgctgcctccagggcggccccgggctgctcctgctccgcagagctacgccctccccccgggtgccccggaccctgcacttgccgccgctttcctcgcgctgctctggaccttgctagccggctctgcacctcccagaagccgtgggcgcgccgctcagctgctccatcgcctcactttcccaggctcgcgcccgaagcagagccatgagaaccccagggtgcctggcgagccgctagcgccatgggccccggcgaggcgctgctggcgggtctcctggtgatggtactggccgtggcgctgctatccaacgcactggtgctgctttgttgcgcctacagcgctgagctccgcactcgagcctcaggcgtcctcctggtgaatctgtctctgggccacctgctgctggcggcgctggacatgcccttcacgctgctcggtgtgatgcgcgggcggacaccgtcggcgcccggcgcatgccaagtcattggcttcctggacaccttcctggcgtccaacgcggcgctgagcgtggcggcgctgagcgcagaccagtggctggcagtgggcttcccactgcgctacgccggacgcctgcgaccgcgctatgccggcctgctgctgggctgtgcctggggacagtcgctggccttctcaggcgctgcacttggctgctcgtggcttggctacagcagcgccttcgcgtcctgttcgctgcgcctgccgcccgagcctgagcgtccgcgcttcgcagccttcaccgccacgctccatgccgtgggcttcgtgctgccgctggcggtgctctgcctcacctcgctccaggtgcaccgggtggcacgcagacactgccagcgcatggacaccgtcaccatgaaggcgctcgcgctgctcgccgacctgcaccccagtgtgcggcagcgctgcctcatccagcagaagcggcgccgccaccgcgccaccaggaagattggcattgctattgcgaccttcctcatctgctttgccccgtatgtcatgaccaggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagagggagccccctcctcagcacagacctgtcctgcttggtggggccctgatgagctcatgcagggtgagcccttcgcctgcctgacccaccaggagcctctgcccaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccac

SEQ ID NO: 136034 - DNA, 3349 bp, Homo sapiens
  Payload ID: 6624
  Gene Symbol: GPR82
  Gene Name: G protein-coupled receptor 82
  Uniprot ID: Q96P67
  ENST ID: ENST00000302548
  CDS Start-End: 241-1251
agttggtgtcatgcaagaatctattcacactgactaaagatattggaagagtgaagatcagagaattttaagtctgaaatttggcatcactgccctgaacaatataaccttagttggcataaactactcatacagacaaaggcattatccatcacaataagtaactttttgtctttatttcaaccggacaatcgtgattagaaaagctcctgtgacaaaattcaagaaaacctgacataaatgaacaacaatacaacatgtattcaaccatctatgatctcttccatggctttaccaatcatttacatcctcctttgtattgttggtgtttttggaaacactctctctcaatggatatttttaacaaaaataggtaaaaaaacatcaacgcacatctacctgtcacaccttgtgactgcaaacttacttgtgtgcagtgccatgcctttcatgagtatctatttcctgaaaggtttccaatgggaatatcaatctgctcaatgcagagtggtcaattttctgggaactctatccatgcatgcaagtatgtttgtcagtctcttaattttaagttggattgccataagccgctatgctaccttaatgcaaaaggattcctcgcaagagactacttcatgctatgagaaaatattttatggccatttactgaaaaaatttcgccagcccaactttgctagaaaactatgcatttacatatggggagttgtactgggcataatcattccagttaccgtatactactcagtcatagaggctacagaaggagaagagagcctatgctacaatcggcagatggaactaggagccatgatctctcagattgcaggtctcattggaaccacatttattggattttcctttttagtagtactaacatcatactactcttttgtaagccatctgagaaaaataagaacctgtacgtccattatggagaaagatttgacttacagttctgtgaaaagacatcttttggtcatccagattctactaatagtttgcttccttccttatagtatttttaaacccattttttatgttctacaccaaagagataactgtcagcaattgaattatttaatagaaacaaaaaacattctcacctgtcttgcttcggccagaagtagcacagaccccattatatttcttttattagataaaacattcaagaagacactatataatctctttacaaagtctaattcagcacatatgcaatcatatggttgacttttgaatggaaaaccccacaatattaagaaaagcattcatgtgactttattagggacactaaactacatcattaacatgtcacagcttggttgacaataatcaccaagaaaatctctttggtttttaaaaataaataaacatatattcataaaactcaaaaaacagttatactgaacgttgagatggcagaaactttcagaagcaaaaattaagcatattgaaaggatcccactcatatgaaactaacaggctgttttctgtttaaactcaactgtcagtgcttctgttcagaacacgttatttcatgactaggataaagaagcaaatggtttatgacttgtctgctttctggtagttagaatacaagggtcaatctatggctagtgtttattggtaattttaaaatctttaaaaataagtagctgggcacagtggcttacgcctgtaatcccagcactttgggaggctgaggtgggtggatcattttgaggtcaggagttcaagaccagcctgggcaacatggtgaaaccctgtctctactaaaaatacaaaaatcagctggacatggtggtgggcgcctgtaatcccagctactcgggaggctgaggcaggagaatcgcttgagcccgggacggaggttgcagtgagcggagatcgtgccactgcactacagcctgggaggcagagcgagactctgtctcataaaacaaaacaaaaaaataaaaataagtaaaaaaataaataagaaatatcctcattcacatcttacctaaatgcatgaataatacagtgaaaaaaatccaaggttttataaacatattatttatttgaaattatctggctcatgttattggggagaagcaatattcattgactatatttttaaagcagatgatacttataaaaatgcttaaatatttggattaggctttgtcaaagtaaaaagctatgtcattatatgcccatcttcatcacattgtgcatattttcttctgtattcaatataaataatgttattagtgacaaacagtacctggcagttaattttttgtgaaataaatgaatgaataataagggagtgtaatagtattgcagttaagagattgatctctgaagttatacttcttgggttcaatctggctctactttttatttagctggacaatcttaggcaaattaacttatcctctgtacgtgttaatttcttcatttgtagagcagaaaatactatcttatttacagatcctattattaaatcagctgttactattatgagtagctaacgcttagtaagcacttgctgtttgccaagcattctacttatatgctttacatatattattttaatcaccacaactctaaagtatactaatttactgatgaaaatattgaagtgggctgggtgcggtggctcatgcctgtaatcccagcactctgggaggccgaggtgggcagatcacctgaggtcaggagttcgagactagcctggccaacatggcgaaacccacctctactaaaaatacaaaaattagctgggcgtggtggtgtgtgcctgtagtcccagctacttgggaggctgaggcagaagaatcacttgaactcgggaggctgaggcaggagaatcacttgaactcaggaggcggaggttgcagtgagccaagatcatgccattgcactccagcctgggcgacagagtgagactctgtctcaaaaaaaaaaaaaaaaaaaaaaaaaaaaaaaaatatatatatatatatatatatatatgtatgtatgtatgtatatgtgcatagttaagtaaatcaccccaattttttctaatatttaagtgaacatttaaagataagcatttcttaatgttaatttcttttctttcatgtaatcttgtcagtagacaaatgatggtgactatattctgtaataagtacatatattatgattaaaaaaaaaagcgtgtactatctgcccaaagagatcataagcactttggagctataaacttcttgtctatttctacttccatggtactgatattctcttctcagataaccaaacaaaaacagctgaataaaatcaaccattaatagtaacttgc

SEQ ID NO: 136035 - DNA, 4282 bp, Homo sapiens
  Payload ID: 6625
  Gene Symbol: GPR83
  Gene Name: G protein-coupled receptor 83
  Uniprot ID: Q9NYM4
  ENST ID: ENST00000243673
  CDS Start-End: 173-1444
gtgccgaccgcgggctggtggcgggcggcgcggtgctccgcgcgtccgggctccctggctcctcgggacggccttgtatgctgtgcgccccgcaccccggctgcgcgctccgatcccagcgggaggggacgcccggcccgcaggctcccaggggaggggtggctcctgcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgctgagtcccagaaccccacggtgaaagccctgctcattgtggcttactccttcatcattgtcttctcactctttggcaacgtcctggtctgtcatgtcatcttcaagaaccagcgaatgcactcggccaccagcctcttcatcgtcaacctggcagttgccgacataatgatcacgctgctcaacacccccttcactttggttcgctttgtgaacagcacatggatatttgggaagggcatgtgccatgtcagccgctttgcccagtactgctcactgcacgtctcagcactgacactgacagccattgcggtggatcgccaccaggtcatcatgcaccccttgaaaccccggatctcaatcacaaagggtgtcatctacatcgctgtcatctggaccatggctacgttcttttcactcccacatgctatctgccagaaattatttaccttcaaatacagtgaggacattgtgcgctccctctgcctgccagacttccctgagccagctgacctcttctggaagtacctggacttggccaccttcatcctgctctacatcctgcccctcctcatcatctctgtggcctacgctcgtgtggccaagaaactgtggctgtgtaatatgattggcgatgtgaccacagagcagtactttgccctgcggcgcaaaaagaagaagaccatcaagatgttgatgctggtggtagtcctctttgccctctgctggttccccctcaactgctacgtcctcctcctgtccagcaaggtcatccgcaccaacaatgccctctactttgccttccactggtttgccatgagcagcacctgctataaccccttcatatactgctggctgaacgagaacttcaggattgagctaaaggcattactgagcatgtgtcaaagacctcccaagcctcaggaggacaggccaccctccccagttccttccttcagggtggcctggacagagaagaatgatggccagagggctccccttgccaataacctcctgcccacctcccaactccagtctgggaagacagacctgtcatctgtggaacccattgtgacgatgagttagaagaggttgggaagagggagtgggaggggtctgtctccacctgaggcagggaaagagagcctattctcacacatgatcttcagagtgctggaaacacactcctgcagaagctgtaggactcttgaattcctaggaaactgtccagcctcctagccccatgtgatgtgaaaactaaaaggcaccaccaactagacatgtgttcataaattcccatctaagaaacactgggaggcacagcagcctgtatctctgaggaagaggagcgaggacaacgttggcccagatgggggctgaatcattcaactgcctccatctgtggggcagctgctgccttacagcccttcctactgctgagcatccctaagggagacctaaatcatactttgggtgtggtgacccagatgcacagagctctgcttgaaacaggtacacgggccagggaaatgccagcaagccagagcgggcgtggagatttttatgcctcactttctggagtcactgggccatgatgaatcataagtcttcagtggcctagcaatatccagataagaaaggaccaacttgggttccttaaaacaaagggaaattattattgccacttagaaaaattcagaaaagcacacactcacatacacacacacaaaatcactctcttatcccatccatttgtgataacatctgtgaacatgctgtggctctatttgcaacattttccttcgtgtgtgtgattgtgtgcatgtgtgcatgaccttttttttttctttttttttttttttttgagatggaatctcgctctgtcacccaggttggagttcagtggcacaatctcggctcactgcaagctctgcctcccaggttcatgccgttctcctgcctcagcctccctagtagctgggactacaggtgcccgccaccatgcccggctaatcttttgcatttttagtagagacggggtttcaccgtgttagccaggatggtctcgatctcctgacctcgtgatccacctgcctaggcctcccaaagtgttgggattacaggcgtgagccaccccgcccggcccttttttttcatttatactttttcatttagattgtaatgattaacagaaacaggggtacctttcccaggggtgtccaccagaagagttgaagaagaggtgagaagatcccaaggtgaagcctgtcaccacgcagacagaactgccccctattgtagacagtggtgggaagggcctggctcacatgcccctccttagaggcagcctcaagatgaaccagggaatcaaactcaaccaggaggcatgattccttctctcctgcaattgcacaaaaacaagtggtggtgaaacattgttctgttttcacaagagatgagggagcaggctttccaatatgctggaagtaattgtgcttagacacctcatcctcccaagctgtctagaaaggccatttcgctgtgttgtctaaataatgagggttttttcacaccatttctcaaaaggagattcgctgtcaacatcattttggtggttcaggtgtaactttcacttacagaaacttatgcatccttaagagatctcaattcttaagggtctaacttgccagagaaatctcattccagggactgattgtttttatcaccttctgtctggtcctgagtgactcactgtgtcacccagaaaagagacctgtcaggcagaatcgagcttaattcacctgctctaaacaattgttactgacacactgcttttaggttttcttctagcaccagataaactctgaaatcaaagcatggatatgagctcagtaggaaactaaggtttgagggagaaagagtttgtcacttagacctcttggctgttaactgaaactgaacttgctcacatcatctgcttccctgtaatgaactatgagggttctttatcctagtttctatttatgaagatggttgaaaattttcaagacacaagattttgaaaactcactgaattatgggcaaaaccatgactttcattgggcagacagagtcttctaagcccacagggatccccagatggatttttcaggacaaatggctcatgtgcctgtacttattgtctctgtggtgtgtcaagaagtagctaatggtttcatctgaaagctgccatagaaattctgtgaaccagaatgagacaaggcagcaggcatacagaaggtttgtcctgctctgggaagcatggaggatgttgtacttcactcctctctgagggtgtctaggaatacagaagctccttgacttacatctcaataaacccatcgtaagtccaaaatattggaagttgaaaatgcattgaatacacccaacctactgaacatcgtagcttagccaagcctaccttaaatgctctgagaacacttatattagcctacagctgggaaaaatcatttaacacaaagcctatcttctaatgaagtatggaatatctcatgtaatttattgaatactgtactgaaggtgaaaaccagaatggttgtatggatatgcgaagtatggtttctactgaatgtgtattgctttcccatcatcataaaatttttaaaaatcctaagttgaatcattgttagtccgggaccttcagtactgccaagtcccagagaaaacccttttactctggggagaacccactgatggctcattagatctgtcccttccccgaggtccgtgtgtgactttgagcaaaaagtgacttctttttgtgaatgtaaaatttgtgaaacttgagtttttccaatgtgctgtaaagtgttttattgtaaattgctcatctcaataaaatttacttcaggtttgtggactgtg

SEQ ID NO: 136036 - DNA, 1909 bp, Homo sapiens
  Payload ID: 6625
  Gene Symbol: GPR83
  Gene Name: G protein-coupled receptor 83
  ENST ID: ENST00000539203
  CDS Start-End: 146-1291
gcgcggtgctccgcgcgtccgggctccctggctcctcgggacggccttgtatgctgtgcgccccgcaccccggctgcgcgctccgatcccagcgggaggggacgcccggcccgcaggctcccaggggaggggtggctcctgcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgctgagtcccagaaccccacggtgaaagccctgctcattgtggcttactccttcatcattgtcttctcactctttggcaacgtcctggtctgtcatgtcatcttcaagaaccagcgaatgcactcggccaccagcctcttcatcgtcaacctggcagttgccgacataatgatcacgctgctcaacacccccttcactttggtcatcatgcaccccttgaaaccccggatctcaatcacaaagggtgtcatctacatcgctgtcatctggaccatggctacgttcttttcactcccacatgctatctgccagaaattatttaccttcaaatacagtgaggacattgtgcgctccctctgcctgccagacttccctgagccagctgacctcttctggaagtacctggacttggccaccttcatcctgctctacatcctgcccctcctcatcatctctgtggcctacgctcgtgtggccaagaaactgtggctgtgtaatatgattggcgatgtgaccacagagcagtactttgccctgcggcgcaaaaagaagaagaccatcaagatgttgatgctggtggtagtcctctttgccctctgctggttccccctcaactgctacgtcctcctcctgtccagcaaggtcatccgcaccaacaatgccctctactttgccttccactggtttgccatgagcagcacctgctataaccccttcatatactgctggctgaacgagaacttcaggattgagctaaaggcattactgagcatgtgtcaaagacctcccaagcctcaggaggacaggccaccctccccagttccttccttcagggtggcctggacagagaagaatgatggccagagggctccccttgccaataacctcctgcccacctcccaactccagtctgggaagacagacctgtcatctgtggaacccattgtgacgatgagttagaagaggttgggaagagggagtgggaggggtctgtctccacctgaggcagggaaagagagcctattctcacacatgatcttcagagtgctggaaacacactcctgcagaagctgtaggactcttgaattcctaggaaactgtccagcctcctagccccatgtgatgtgaaaactaaaaggcaccaccaactagacatgtgttcataaattcccatctaagaaacactgggaggcacagcagcctgtatctctgaggaagaggagcgaggacaacgttggcccagatgggggctgaatcattcaactgcctccatctgtggggcagctgctgccttacagcccttcctactgctgagcatccctaagggagacctaaatcatactttgggtgtggtgacccagatgcacagagctctgcttgaaacaggtacacgggccagggaaatgccagcaagccagagcgggcgtggagatttttatgcctcactttctggagtcactgggccatgatgaatcataagtcttcagtggcctagcaatatccagataagaaaggaccaacttgggttccttaaaacaaagggaaattattattgccacttagaaaaattcagaaaag

SEQ ID NO: 136037 - DNA, 1497 bp, Homo sapiens
  Payload ID: 6626
  Gene Symbol: GPR84
  Gene Name: G protein-coupled receptor 84
  Uniprot ID: Q9NQS5
  ENST ID: ENST00000267015
  CDS Start-End: 91-1281
taactgtccaccagaaaggactgctctttgggtgagttgaacttcttccattatagaaagaattgaaggctgagaaactcagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgcttttaa

SEQ ID NO: 136038 - DNA, 2041 bp, Homo sapiens
  Payload ID: 6626
  Gene Symbol: GPR84
  Gene Name: G protein-coupled receptor 84
  Uniprot ID: Q9NQS5
  ENST ID: ENST00000551809
  CDS Start-End: 637-1827
cctgcttgaagcctaactgtccaccagaaaggactgctctttgggtgagttgaacttcttccattatagaaagaattgaaggctgagaaactcaggtaagcacttttgttgtgggtatacttttaccttcttggtctcctcatctcccaggtggtaacaaacagaaatgactaaagcctatatgtgtgtgtagtggaaaggagcagagggaactgaatacagagaggatcctgaatacacgatgctgaatagagagaggggactcctgggggtctttggggatggggaaggaattaaaaaagttggagggcactgggtttactgagagcagcgggatggatatagaagaggactgaggtttggagcagaataagactaagatatttaggcaagagatatttagataaaaacttggggaaatatttgagaatgggaaaggactaagagaacctaaggagagagttagggatcttgagatgaagaggcctgggaatggttcaggaggatactgaattaaggtgaggtccaggaacagtttagatgtccagggtcccagaactgttcaagagatctaagttgaatgctaggttctgattccctcttcctcttccaccctctgcctctttagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgctttt

SEQ ID NO: 136039 - DNA, 5079 bp, Homo sapiens
  Payload ID: 6627
  Gene Symbol: GPR85
  Gene Name: G protein-coupled receptor 85
  Uniprot ID: P60893
  ENST ID: ENST00000297146
  CDS Start-End: 605-1717
tattttactgctgtctcaagatcagattattactgtagagaagatttttattttttgtttcattaacagattattataaagcaaaaagcatgcagaaaaagaagcagacgttttacattgggaattaatgaaagcgtgtctgctagttttgggtaggagaactgggaagttgttgcttaaaattttatatcacctccacaaacaaaactcttcggaaatggtaaaataagaaaatgcatgattctagaggcattcctaagcacccacgtgtcaggctttgtggtgtctgtggtatcatccgaccgtttggactggttagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaatttacccgtgtagcctgttaattttcttgaaataagttttacatttttggcacataacaactttttttttaatttgggaggcaagcacaaactaggaagactagctttattatggttttgctttttgattcttgtagctactacattccagactggaaatgtatgaatgataatcaacataatgctgataaactgacataatattatctgtaaaagcattatttggtagtttattataatcatccctctattattcttaaatgccagtagtatttagagatgtgtacctgcttagttaattggctcagaattttaatataaacatcacactttaatttggagcatagtaccatagaaatttggggttctaaatatacaacttgtaagaagaatggtttacactaacattatgacaaaactagaaaaagttattatttttgtttgctttctgttgttttgtttattggttggtttttgtgaagtttatttttttttggtatttgataattaagattaggaatctaataacacagaattccatattgctatagtacttctgtaaagagaatatcaatataaataaggaaaataaatcaatgaaatgtttcaatgatatatgcaactattcagttttgctcttataaggacagctcaagccatgaattagtgagcattctgacctcatttttactttacaccaaagttgattagatctgagacaaaatttaatgcacaacagtgagttggatctagcaataaagtctccttggtactgaaatcattatctaaaataaaggaaatgttatcaaaagatgttctgataacattgtgattgtaactcaaaaaaatttatagtagaaacgtaattgcaatgatgataataactaactctgcttagaggttcaaatatcaccagcaatcagtaaaaaattcagcaataatcttaaggccagagagaacaggttcaccattgcatagacaagaaaacagatatgggttaagagttggggactgaggagtcaagagcaacggccacgtgaagctgcctgactccacctagctatttggaataaccgattcccacagttttggtaagaaaccagccccagtaatcagtaagtcaggctgaactgcagtgacttttatttaagcctactcctgactaacttggcatttgcaggtcaagcaggaagcagttgacaagacacatcctcagtgaatcaatgccatttgtaactcaactggtaacagtagtaatcatacaaaataaaaacctgcttcagtgtcttaatgaccaaatcacattatctattttagcactcattccaaaattcagtatttaatgtaattaatctttaatccataaaaatacatccccactgtagcggggcagggggtgtccaacttccctgtgagactgattatcaataataatgtgtctccctcttggactgagcacacatctgagctgaacggcctttaaattgtttttcataatagtggtgatatgtttgcgtggatacgtctgtactatttcatctggttcattttgcatgtaatagatttatctgtgagatgcctggctgaagctaggcattcagtctgtgactgtggaatcctatgcaggtattaaccaaggcagaaagaggtgagtaacttgcccatttctccacagagaccccatttaaataacacaaaattgaccacagtgattagatgaaaaaattatttgtagataggataatctattgactgaattatcttttgcagatatcagctggttggatttctcaccaggattgtctatagaagttaactgatttatgattgttaacacataaatatggccacttatccatttgcctcaacttccatggatgctacctgaattgtttgttcatttatttactttttcaacaaatatgtgctgggtgctgggcttggtgctgagtgcatagtggaaaacaaagcagaacagtctctcatttagatttcttaatctagtgggaaagaaacaataaatacatagtagcaatga

SEQ ID NO: 136040 - DNA, 2895 bp, Homo sapiens
  Payload ID: 6627
  Gene Symbol: GPR85
  Gene Name: G protein-coupled receptor 85
  Uniprot ID: P60893
  ENST ID: ENST00000424100
  CDS Start-End: 455-1567
cgccgccgagccctgcctggatgctcagtcaaggcactaaggcaaaaaaaaaaaaaaaaaaaacaaaaaacaaaaaaaaaaaaaaaaaaaagaaaaagaaaaaaagaaaaaaatcagcaatttatagaaagaagctatagtctgtcgggatatccaacaccaacagtagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaattta

SEQ ID NO: 136041 - DNA, 1630 bp, Homo sapiens
  Payload ID: 6627
  Gene Symbol: GPR85
  Gene Name: G protein-coupled receptor 85
  Uniprot ID: P60893
  ENST ID: ENST00000449591
  CDS Start-End: 518-1630
atatccaacaccaacaggtaggaggatatactcttggttaagtttgggggatgtgggggaatgcacagtgttgatgaaactgcaggttcaccgagaaagagccctccctcaggttgtgtgtgtgtgtgtgtgtgtgtgtgtctctgtgtgtgtgtgtgtgtgtgtgtgtgtatgtgttttgtgacaataaactgcataatggaagtacattcagacaatgcatcttcagtagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatga

SEQ ID NO: 136042 - DNA, 582 bp, Homo sapiens
  Payload ID: 6627
  Gene Symbol: GPR85
  Gene Name: G protein-coupled receptor 85
  ENST ID: ENST00000449735
  CDS Start-End: 219-582
aatttatagaaagaagctatagtctgtcgggatatccaacaccaacagatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttag

SEQ ID NO: 136043 - DNA, 591 bp, Homo sapiens
  Payload ID: 6627
  Gene Symbol: GPR85
  Gene Name: G protein-coupled receptor 85
  ENST ID: ENST00000438062
  CDS Start-End: 379-591
aaaaaaaaaaaaaaaaaagaaaaagaaaaaaagaaaaaaatcagcaatttatagaaagaagctatagtctgtcgggatatccaacaccaacagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgca

SEQ ID NO: 136044 - DNA, 4106 bp, Homo sapiens
  Payload ID: 6627
  Gene Symbol: GPR85
  Gene Name: G protein-coupled receptor 85
  Uniprot ID: P60893
  ENST ID: ENST00000610164
  CDS Start-End: 269-1381
atttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttatatcagctggttggatttctcaccaggattgtctatagaagttaactgatttatgattgttaacacataaatatggccacttatccatttgcctcaacttccatggatgctacctgaattgtttgttcatttatttactttttcaacaaatatgtgctgggtgctgggcttggtgctgagtgcatagtggaaaacaaagcagaacagtctctcatttagatttcttaatctagtgggaaagaaacaataaatacatagtagcaatgagttgtgagtgttaatatggtaaaaattccctaagaagaacttggtcataatggccataaatggactgttctccattttcacttcagtgccttatcacctatctttgcccagtgttatttgggatctcgtatatattatacatactccctcaactgagagggaaccccctcattctattcaaagcaccaggaacctttcacccacacttacacgaatcagcgtgttgtattttagaaccagctcccatgtagttaattctatctacataataacagcaaaatctattttcccttccaaagttcccttcatatcccaactatccacttccaaaacagagatatttcaattgctttaagagacatggaggtgtcttttctgacatactcacatgttcctgcaagataggatgaaaatgcgtgggtaaaatgcaatcaaaggaatgacttatttgtgtgcatcttacgatgacttgcgggggccctcccaagtaacttgtgaaacagggtgcatatcttttattattaaagcatgccaccccgtcaatgttttttttttgctccttaattggaatacaataaaactccctaatcgcctatcagctgaaaacttggtttggcctccaaaatttacttctattgtaagtacaatgaaactgatttataaccatacagattacatttttcagctaaactgtgtcataatgagttgggttgcacctgggattactgtaggacagttgcaaacagagccaaaactcttcacttctgtgtattcactattggataaatttactgggtttcattatttcatgccatatgtagcatagactgtattattattattaaaacaaaagcagtttgcattaatttcatattaaaaagaaaagaaagaagctaagatgataaatggtgatgtttcaaatactggctaaagacattaatcaaggtagatggtaaccagaattgtgggttatttatggttctaaaaccttgtgagtttatttttctatgcaaaaatatatcattttcatgtttgttaatattctcttataaatgttttaaatggaaattgcaggatatactaagaactgtttactgctgaaattttttgttgttattgtcaactgtgggcatgtcagcatctgtgagttttctaattccctcagaaactttttttacaccacattaaaatggtagaattgctcagttttgatgcaaaaattcataattagtctgtatagtggttaaaatgaaaataacatttgcaaatgactggaatttcttttttggccatcagtcaaaacagtcaaataagttaaaggcatatttgaattggagcaacgtagagagaagtttttgttgttgttgttgttgttttgataactgtttttgccttatgctgcaatgtaacaggctctaaataatatattaaaaccaaaaaagctttaactgtatgaaaagattatataaacaagtcctggtttttaaaatggggcaggagttttacatcatccctttttgccaaagggatgatgtccattagctgctcaatccctttgggttaaaaggcttttaaagccagttttcctctcaccataacaggcagttattacaaggactggctccctgaaaggtccccagaggaaatcaaggagactgtgtttccctctgagtaattgaaaaaaaaaaaaaaaaaaaggcctcaaagccacaggtggtttggggttttgaattattcacacctgacattcatagctgcctccttggctccttctggggacgtaggacaacatcgtgctcagaaagacctaggttccaagttcagcttggaggcagaaagcaattcctttttcttctctctgtgtttggaaaataatagattattgacacaaatattaaaactgatactgtaatgca

SEQ ID NO: 136045 - DNA, 1608 bp, Homo sapiens
  Payload ID: 6628
  Gene Symbol: GPR87
  Gene Name: G protein-coupled receptor 87
  Uniprot ID: Q9BY21
  ENST ID: ENST00000260843
  CDS Start-End: 466-1542
agccctctgtgtttccttcaggtgaatcaccatctgattcctgcaggttcaggaaatactcttccccagtcgacaaatctcacctactcttagttatgagtcatttacattagcaagagagcaagttgttccagtagtcgcctggcaggagaatttgaaagggtgccccaaaggacaatctctaaaggggtaagggagatacctaccttgtctggtaggggagatgtttcgttttcatgctttaccagaaaatccacttccctgccgaccttagtttcaaagcttattcttaattagagacaagaaacctgtttcaacttgaagacaccgtatgaggtgaatggacagccagccaccacaatgaaagaaatcaaaccaggaataacctatgctgaacccacgcctcaatcgtccccaagtgtttcctgacacgcatctttgcttacagtgcatcacaactgaagaatggggttcaacttgacgcttgcaaaattaccaaataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacagcataaccttcacgaaggttttatctgtttgtgtttgggtgatcatggctgttttgtctttgccaaacatcatcctaacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattacactgatgtgtaggccttttattgtttgttggaatcgatatgtacaaagtgtaaataaatgtttcttttcattatcctt

SEQ ID NO: 136046 - DNA, 3491 bp, Homo sapiens
  Payload ID: 6629
  Gene Symbol: GPR88
  Gene Name: G protein-coupled receptor 88
  Uniprot ID: Q9GZN0
  ENST ID: ENST00000315033
  CDS Start-End: 440-1594
gggttcaccacatcagccaccactcctgcttctgagcacagggtgctctcctcttgagctcagcttctgcttttgcagccaagcattcttgctgctgctgcctgcctgcccacccgcctgggcttgcagcccgccactttactttctccagccctgataccagctgagaagtctccctgcagctgctagttcctgcccaggaccatgtgtgtggatgctgcttgggagaagcgggcacttgctcctggcactgatcccagctgagtttctcctgttgatttctggaccactgatgctgttgctgaggaggtatttcccggcatccctccccctgagacaccggctaaggaccagcctaaacgcaaggcaggacagtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctttaagtggggcgcccgaagtcattttggacggccacctgatttttaccctttgtttctgtgttttagaggaatcctaaagtcaaaacaccagagacttgaagaacttgcaaactggcgttttaaaataaccggttaatttatttccacacagtttgtttttgaaaaagagctttcataatgtataaccctttccactttcatcgtcttatatatgaagcgccttgagtgtgcatgaaccaaaggaaataacattgaagaaggaaaacaatatgtagaaagtattttagaaagtaacctgtctttgatgatgcttctcttaccatttagtttttgtatattaccctggggcagtgaagccctaggtgtgcccaccagtatgagttgccattaagacctcaagccctttattcttaaaagggtttttaataaagtctttctcaaatgaggtagaatcttagccagtgagaaaaaaaattattttatgctccttttttttcgcactcttaagactgaaaattggcgttgagtgttatagtgaaaattttccagtttgataattgatggtcagagccagcactggaattttgaaaacaaataaggtgattatctattttaggtaccgtttcacattttctatagcatgcacacttgttgctaccctcattttgtaaccaatttatttgccttatgaatgtgattgcagctttgaacattctgtactataatggttgctaagaagaataagtccttctgttttctctttaacatttaaaatatctcaatgcacatgatataattaaacactaataataccatgactgcatagctaatattagctgctattgcatgctcctagatgctagaacttattgggcatgtggtatactgaagcaatacccgttagacaaggatattttacttcttccagacaccagaagaaatggccttcaattatttgaaaagagacacagagacacctctggctacctagagttcttcctgtcttgacccaatttatgagaaagctcccagttgggactttatctcacaagtggaatcacagtcaagacggatcaataatatggtttggctcagcaaagccagctgtgctcttttagggtttaaacaagccacacgttagaaagcaacactgtttttatgtagttcatatatattaccatgacatttaacatcaatatcgtatatgttgaaggaggtataataaactcagtcatatatagtgaacagttcaaatgggaaagtgttctaaaacatattatttgagatttgtcatattcatctttggtttactaaatttacttagaaatatttgaaatgcaaaattgtgtgaaatcaccttatcaaattaaaatgggaagaaagtaattttaataatttttaataatcatatgtcagcattctgactacttaccacatcaaatctgggcccaaacagcctcagttaactgcataattcaggaacaaaaccagcttgctttgttgcacgcctgggcaatttcagccaggacattaggaccacttgttgtacatctgaataattatggaagttgggacatgttaaggaaaacaaatatgttcatcaccaacaatcagctgtcattttattaatctatcccttttgtgcatgcaccatttctctcttactaacagtttcatctgttcacattttccttgattcaaatattaaagttcagacaa

SEQ ID NO: 136047 - DNA, 2120 bp, Homo sapiens
  Payload ID: 6630
  Gene Symbol: GPR89A
  Gene Name: G protein-coupled receptor 89A
  Uniprot ID: B7ZAQ6
  ENST ID: ENST00000313835
  CDS Start-End: 145-1512
agcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatcagttagcatcccacacctcctcatctgatcctgccccattaaaataaccaagaaagaggttatctgttcttttccgggaaaggggtggtatgcacctgaaatagattttaccaaaaga

SEQ ID NO: 136048 - DNA, 548 bp, Homo sapiens
  Payload ID: 6630
  Gene Symbol: GPR89A
  Gene Name: G protein-coupled receptor 89A
  ENST ID: ENST00000524525
  CDS Start-End: 87-254
agaccgtgtgagggggcctgtggccccagcgtgctgtggcctcggggagtgggaagtggaggcaggagccttccttacacttcgccatgagtttcctcatcgactccagcatcatgattacctcccagccccggctgtcaggagactggcctgcggccgtccgcgtccccacccggcatccatccccggaatttcggtccacttttggaagcggtccgccgacctccaggctaagagccggcgccgccagctaaggcggcggttctaggagctcctcgaagcttccgggctgcgccaactgatcctggactggggaagcctgtgtggttctgggcgcgcggtgtgcgacgcgccaatactggatactgaggacacgtcagtgcaggctttgctgttagatgtcaaatcctgaatccgggtgtggagaaatttgctgcttcaaagtatcagtataagatactattttttggatttgggtggcttttcttcatgcgccaattgtttaaagactatgagatacgtcagtatgttgtacaggtgatcttctc

SEQ ID NO: 136049 - DNA, 1527 bp, Homo sapiens
  Payload ID: 6630
  Gene Symbol: GPR89A
  Gene Name: G protein-coupled receptor 89A
  Uniprot ID: B7ZAQ6
  ENST ID: ENST00000462900
  CDS Start-End: 97-1389
gttagatgtcaaatcctgaatccgggtgtggagaaatttgctgcttcaaagtatcagtataagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatact

SEQ ID NO: 136050 - DNA, 919 bp, Homo sapiens
  Payload ID: 6630
  Gene Symbol: GPR89A
  Gene Name: G protein-coupled receptor 89A
  ENST ID: ENST00000466593
  CDS Start-End: 102-791
cacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggagagaatagaatactccaaaaccttcaaggggaaatattttaattttcttggttacttttt

SEQ ID NO: 136051 - DNA, 866 bp, Homo sapiens
  Payload ID: 6630
  Gene Symbol: GPR89A
  Gene Name: G protein-coupled receptor 89A
  Uniprot ID: B7ZAQ6
  ENST ID: ENST00000528944
  CDS Start-End: 108-482
ctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaa

SEQ ID NO: 136052 - DNA, 1644 bp, Homo sapiens
  Payload ID: 6630
  Gene Symbol: GPR89A
  Gene Name: G protein-coupled receptor 89A
  Uniprot ID: B7ZAQ6
  ENST ID: ENST00000534502
  CDS Start-End: 208-1500
agaccgtgtgagggggcctgtggccccagcgtgctgtggcctcggggagtgggaagtggaggcaggagccttccttacacttcgccatgagtttcctcatcgactccagcatcatgattacctcccagcagataaccttgcctcgtacttactcaacaaaagtgaagccaaaagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttcc

SEQ ID NO: 136053 - DNA, 1955 bp, Homo sapiens
  Payload ID: 6630
  Gene Symbol: GPR89A
  Gene Name: G protein-coupled receptor 89A
  Uniprot ID: B7ZAQ6
  ENST ID: ENST00000460277
  CDS Start-End: 145-519
agcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaac

SEQ ID NO: 136054 - DNA, 1934 bp, Homo sapiens
  Payload ID: 6631
  Gene Symbol: GPR89B
  Gene Name: G protein-coupled receptor 89B
  Uniprot ID: P0CG08
  ENST ID: ENST00000314163
  CDS Start-End: 145-1512
agcttgacggcgtcgggctggagagccgcagtcccggctgcagcacctgggagaaggcagaccgtgtgagggggcctgtggccccagcgtgctgtggcctccgggagtgggaagtggaggcaggagccttccttacacttcgccatgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaa

SEQ ID NO: 136055 - DNA, 750 bp, Homo sapiens
  Payload ID: 6631
  Gene Symbol: GPR89B
  Gene Name: G protein-coupled receptor 89B
  ENST ID: ENST00000468618
  CDS Start-End: 102-750
cacctgggagaaggcagaccgtgtgagggggcctgtggccccagcgtgctgtggcctccgggagtgggaagtggaggcaggagccttccttacacttcgccatgagtttcctgatcgactccagcatcatgattacctcccagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccactt

SEQ ID NO: 136056 - DNA, 574 bp, Homo sapiens
  Payload ID: 6631
  Gene Symbol: GPR89B
  Gene Name: G protein-coupled receptor 89B
  ENST ID: ENST00000461786
  CDS Start-End: 1-280
ctgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaat

SEQ ID NO: 136057 - DNA, 683 bp, Homo sapiens
  Payload ID: 6631
  Gene Symbol: GPR89B
  Gene Name: G protein-coupled receptor 89B
  ENST ID: ENST00000491975
  CDS Start-End: 1-385
tctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaagaaataagatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaat

SEQ ID NO: 136058 - DNA, 1954 bp, Homo sapiens
  Payload ID: 6631
  Gene Symbol: GPR89B
  Gene Name: G protein-coupled receptor 89B
  ENST ID: ENST00000488165
  CDS Start-End: 145-519
agcttgacggcgtcgggctggagagccgcagtcccggctgcagcacctgggagaaggcagaccgtgtgagggggcctgtggccccagcgtgctgtggcctccgggagtgggaagtggaggcaggagccttccttacacttcgccatgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaa

SEQ ID NO: 136059 - DNA, 5971 bp, Homo sapiens
  Payload ID: 6632
  Gene Symbol: GPRASP1
  Gene Name: G protein-coupled receptor associated sorting protein 1
  Uniprot ID: Q5JY77
  ENST ID: ENST00000361600
  CDS Start-End: 802-4989
gcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgaccaaa

SEQ ID NO: 136060 - DNA, 5877 bp, Homo sapiens
  Payload ID: 6632
  Gene Symbol: GPRASP1
  Gene Name: G protein-coupled receptor associated sorting protein 1
  Uniprot ID: Q5JY77
  ENST ID: ENST00000415986
  CDS Start-End: 711-4898
gcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacc

SEQ ID NO: 136061 - DNA, 5809 bp, Homo sapiens
  Payload ID: 6632
  Gene Symbol: GPRASP1
  Gene Name: G protein-coupled receptor associated sorting protein 1
  Uniprot ID: Q5JY77
  ENST ID: ENST00000444152
  CDS Start-End: 643-4830
gcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacc

SEQ ID NO: 136062 - DNA, 5980 bp, Homo sapiens
  Payload ID: 6632
  Gene Symbol: GPRASP1
  Gene Name: G protein-coupled receptor associated sorting protein 1
  Uniprot ID: Q5JY77
  ENST ID: ENST00000537097
  CDS Start-End: 814-5001
gacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaagcctggcaacgaggagacgatccgttcggagccgggcgctagagagaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacc

SEQ ID NO: 136063 - DNA, 3720 bp, Homo sapiens
  Payload ID: 6633
  Gene Symbol: GPRASP2
  Gene Name: G protein-coupled receptor associated sorting protein 2
  Uniprot ID: Q96D09
  ENST ID: ENST00000332262
  CDS Start-End: 857-3373
agcagcgacagaaatatggtagtggtcgccacgttagggtccgtgggggcctcctgaggcagcctggtgccaacccgcacgcccaggctggggctcatcctggccctgcccacctcggggtcggaactacggtgggcctgggatgggggcgtcaagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 136064 - DNA, 3847 bp, Homo sapiens
  Payload ID: 6633
  Gene Symbol: GPRASP2
  Gene Name: G protein-coupled receptor associated sorting protein 2
  Uniprot ID: Q96D09
  ENST ID: ENST00000535209
  CDS Start-End: 985-3501
agcagcgacagaaatatggtagtggtcgccacgttagggtccgtgggggcctcctgaggcagcctggtgccaacccgcacgcccaggctggggctcatcctggccctgcccacctcggggtcggaactacggtgggcctgggatgggggcgtcaagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggc

SEQ ID NO: 136065 - DNA, 3935 bp, Homo sapiens
  Payload ID: 6633
  Gene Symbol: GPRASP2
  Gene Name: G protein-coupled receptor associated sorting protein 2
  Uniprot ID: Q96D09
  ENST ID: ENST00000543253
  CDS Start-End: 1073-3589
agcagcgacagaaatatggtagtggtcgccacgttagggtccgtgggggcctcctgaggcagcctggtgccaacccgcacgcccaggctggggctcatcctggccctgcccacctcggggtcggaactacggtgggcctgggatgggggcgtcaagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggc

SEQ ID NO: 136066 - DNA, 4296 bp, Homo sapiens
  Payload ID: 6634
  Gene Symbol: GRK1
  Gene Name: G protein-coupled receptor kinase 1
  Uniprot ID: Q15835
  ENST ID: ENST00000335678
  CDS Start-End: 233-1924
ctccgtgaccccggctgggatttagcctggtgctgtgtcagccccgggctcccaggggcttcccagtggtccccaggaaccctcgacagggccagggcgtctctctcgtccagcaagggcagggacgggccacaggccaagggcagcagtcaggcctgctctgtctgtgaacgctcccggcttggcctcggctgatgggccctcacgcctgaagcgggcaggaagctccgggatggatttcgggtctttggagaccgtggtggccaactctgccttcatcgccgcccgaggcagctttgacggcagcagctcccaaccctcccgggacaagaagtacctggccaagctcaagctgcccccgctgtccaagtgtgagtccctccgcgacagcctcagcctggagtttgagagtgtgtgcttggagcagcccatcggcaagaagctctttcagcagttcctacaatcggcagagaagcacctgccggccctggagctctggaaagacatcgaggactatgacacggcagacaatgacctccagccacagaaggcccagaccatcctggcccagtacctggacccccaggccaaactcttctgcagcttcctggatgaggggatagtggcgaagtttaaggaggggcctgtggagatccaggacgggctcttccagcccctgctgcaggccaccctggcacacctgggccaagcccccttccaggagtacctgggcagcctgtacttcctgaggttcctgcagtggaagtggctggaagcccagcccatgggggaggactggttcctggacttcagggtcctagggaaagggggcttcggggaggtgtcggcctgccagatgaaggcgaccggcaagctgtatgcctgcaagaagctgaacaagaagcggctgaagaagaggaagggctaccagggtgctatggtggagaagaagattctgatgaaagtacacagcaggttcatcgtgtctctggcctatgcgtttgaaaccaaagccgacctctgtctggtgatgaccatcatgaacggaggtgacatcaggtaccacatctacaacgtgaatgaggagaaccctggcttcccggagccgcgcgccctcttctacacggcgcagatcatctgcggcctggagcacctgcaccagaggcggatcgtctaccgcgacctcaagcccgagaacgtgctgctggacaatgacggcaatgtccggatctctgaccttgggctggccgtggagctgctggacggacagagcaagaccaagggctacgcagggaccccaggtttcatggcccccgagctcctgcagggcgaggagtacgacttctccgtggactactttgccctgggggtcaccctgtatgagatgattgcggccagaggacccttccgagcccgtggagagaaggtggagaacaaggagctgaagcaccggatcatctcagagcccgtgaagtaccctgataagttcagccaggccagcaaggacttctgcgaggcgctgctggagaaggacccggagaagcgcctggggttcagagatgagacctgcgacaagctccgtgcccaccccctcttcaaggaccttaactggaggcagctggaggctgggatgctgatgccccctttcatcccagactccaaaactgtctacgcaaaggatattcaggacgtgggtgccttttccaccgtcaaaggtgtggcctttgacaaaacagacacagaattctttcaggaatttgccactggcaactgccccatcccctggcaggaggagatgatcgagacgggcatctttggcgagctgaacgtgtggcgctcggacggtcagatgccggacgacatgaagggcatctccgggggctccagctcctcgtccaagtcagggatgtgtctggtttcctaggtgacgccccagagtccacgtggaggaaaaggacccatacggctcgatgggggccgcctgcctccgtggtgccagcctggggtctgctagcaaggggacacgtggttccctccacccaggtccccatcacgccatctccttgcggcccaaggaggagaaagcccacatcggcctgagccgccagacgcacatgctggtgccgtgagcccccgactgcatatttcacgtcttttgctccatctcactgagaagacataagatgctctccagagggagtaagccaaaaatctacaaactcttagggagcctcctgcattggtgattgaccaaccgtgtggtcaggggcagagactcggttttggcctcccaagaccttagccattggcttcccagagccacgctcctcagcgggaggtgcacggtggccaggtcaggggtcagtgaaccctggccgcagcccctggccccactggggagggctggacctcgccccccccaggtccctctgtgcaggctcctgacttccagggtgcccgggccctgtgctggtggcctgcacgccacatggtcccctgcaccctgcggcgccgtggtcctctgcacactggggcaccatggtcccctgcactccggggtgccatggtccacatctgccaggcgcaggctctgttgggctgttgggaggaggggagcgggtgtggagtctgggggtctcagtgcatcttggggtctccttatctcagggtgtccagctgacggcagctggtgcaaagttcccacccctgagctggggagctgaaaatgttttctgtcttgaccctgagtcccggaagcacctcagctgctcttggcgggcaaagccaggaccgtttgctctctgaccctcctccccactggggctggtccgtctcatctcccaggggacacttcaggccacgggccttgtgcatagggacagagctccttgctgcaacccctctctgtgttcccagtagcagcagcactggagtcctaaagccatagcccgggaagacactcacagcccaccttctcatacagctcggccccacccacaatgcacctggcatttccaactgcactttgaacactgaaggttccccaaatgctttgtgtgttttaactgcaggaagttagttctgttgcaactgcctccaggacacactccctcttgagggccggcggtgctggcctgggttccatggcctcagcagccggctcagagggagtgcatccaagccgcagggaagcagtggtgatgggcggcctgaggactcctttccagagagggcctctgagctccttttaggaaagaacttcctttgagccccggccactgttgtaccagtgggagaagaagcctgaccctgccacatgtggtcacggggagagaagatggtaggacgtccccgtgagccttggggcagagctggtggtagaaagaagccctgtctactctaatttggtgagaggggccgcggcaagtggctgatgatgtgactgatggagacagggtggcttgggaaggtcccacttgggggtgtcacgtcctgcagggagtggaagagatggatcctccgtagcctggactggtgggtctcggcctctctcccagaaatggcagagacagctgcctgagagtcagtgctgcagtgggcagggcctatgccctcacagtcctcaggctgccaggtcgtcctcttcctgttggggagaagaggaccctggcaatccacaattttggagatttgctggctgcagccaaaatggggacccaactccctcctatgtggttttagagcttctggagggaagataggccacgcccctgggtgaggagcacgtcttcccacagatcctaagtcggccacaccctgggtgaggagcacgtcttcccataggtcccacgtcagccacaccctgggtgaggagcacgtcttcccatagatcccacatcggccacaccctgggtgaggagcatgtcttcccatagatcccacgtcggccacaccctgggtgaggagcacgtcttcccatagatcccacatcggccacaccctgggtgaggagcatgtcttcccatagatcccacgtcggccacaccctgggtgaggagcacgtcttcccatagatcccacgtcggccacaccctgggtgaggagcatgtcttcccatagaacccacgtcggccacaccctgggtgaggagcacgtcttcccacagatctcaacagaactccacatcgtctggttttgtggagactttcatatgtcctgtcaagttgcctcatgcacctgcagactgttcttgggaagcaaacctggactgcaaaataaacctcccggcctcctcct

SEQ ID NO: 136067 - DNA, 2867 bp, Homo sapiens
  Payload ID: 6634
  Gene Symbol: GRK1
  Gene Name: G protein-coupled receptor kinase 1
  ENST ID: ENST00000631997
  CDS Start-End: 1-623
gtttcatggcccccgagctcctgcagggcgaggagtacgacttctccgtggactactttgccctgggggtcaccctgtatgagatgattgcggccagaggacccttccgagcccgtggagagaaggtggagaacaaggagctgaagcaccggatcatctcagagcccgtgaagtaccctgataagttcagccaggccagcaaggacttctgcgaggcgctgctggagaaggacccggagaagcgcctggggttcagagatgagacctgcgacaagctccgtgcccaccccctcttcaaggaccttaactggaggcagctggaggctgggatgctgatgccccctttcatcccagactccaaaactgtctacgcaaaggatattcaggacgtgggtgccttttccaccgtcaaaggtgtggcctttgacaaaacagacacagaattctttcaggaatttgccactggcaactgccccatcccctggcaggaggagatgatcgagacgggcatctttggcgagctgaacgtgtggcgctcggacggtcagatgccggacgacatgaagggcatctccgggggctccagctcctcgtccaagtcagggatgtgtctggtttcctaggtgacgccccagagtccacgtggaggaaaaggacccatacggctcgatgggggccgcctgcctccgtggtgccagcctggggtctgctagcaaggggacacgtggttccctccacccaggtccccatcacgccatctccttgcggcccaaggaggagaaagcccacatcggcctgagccgccagacgcacatgctggtgccgtgagcccccgactgcatatttcacgtcttttgctccatctcactgagaagacataagatgctctccagagggagtaagccaaaaatctacaaactcttagggagcctcctgcattggtgattgaccaaccgtgtggtcaggggcagagactcggttttggcctcccaagaccttagccattggcttcccagagccacgctcctcagcgggaggtgcacggtggccaggtcaggggtcagtgaaccctggccgcagcccctggccccactggggagggctggacctcgccccccccaggtccctctgtgcaggctcctgccttccagggtgcccgggccctgtgctggtggcctgcacgccacatggtcccctgcaccctgcggcgccgtggtcctctgcacactggggcaccatggtcccctgcactccggggtgccgtggtccacatctgccaggcgcaggctctgttgggctgttgggaggaggggagcgggtgtggagtctgggggtctcagtgcatcttggggtctccttatctcagggtgtccagctgacggcagctggtgcaaagttcccacccctgagctggggagctgaaaatgttttctgtcttgaccctgagtcccggaagcacctcagctgctcttggcgggcaaagccaggaccgtttgctctctgaccctcctccccactggggctggtccgtctcatctcccaggggacacttcaggccacgggccttgtgcatagggacagagctccttgctgcaacccctctctgtgttcccagtagcagcagcactggagtcctaaagccatagcccgggaagacactcacagcccaccttctcatacagctcggccccacccacaatgcacctggcatttccaactgcactttgaacactgaaggttccccaaatgctttgtgtgttttaactgcaggaagttagttctgttgcaactgcctccaggacacactccctcttgagggccggcggtgctggcctgggttccatggcctcagcagccggctcagagggagtgcatccaagccgcagggaagcagtggtgatgggtggcctgaggactcctttccagagagggcctctgagctccttttaggaaagaacttcctttgagccccggccactgttgtaccagtgggagaagaagcctgaccctgccacatgtggtcacggggagagaagatggtaggacgtccccgtgagccttggggcagagctggtggtagaaagaagccctgtctactctaatttggtgagaggggccgcggcaagtggctgatgatgtgactgatggagacagggtggcttgggaaggtcccacttgggggtgtcacgtcctgcagggagtggaagagatggatcctccgtagcctggactggtgggtctcggcctctctcccagaaatggcagagacagctgcctgagagtcagtgctgcagtgggcagggcctatgccctcacagtcctcaggctgccaggtcgtcctcttcctgttggggagaagaggaccctggcaatccacaattttggagatttgctggctgcagccaaaatggggacccaactccctcctatgtggttttagagcttctggagggaagataggccacgcccctgggtgaggagcacgtcttcccacagatcctaagtcggccacaccctgggtgaggagcacgtcttcccataggtcccacatcagccacaccctgggtgaggagcacgtcttcccatagatcccaagtcggccacaccctgggtgaggagcacgtcttcccatagatcccacgtcggccacaccccgggtgaggagcacgtcttcccatagatcccacatcggccacaccccgggtgaggagcatgtcttcccatagatcccacatcggccacaccccgggtgaggagcacgtcttcccatagatcccacgtcggccacaccctgggtgaggagcacgtcttcccatagatcccacatcggccacaccctgggtgaggagcacgtcttcccatagatc

SEQ ID NO: 136068 - DNA, 2013 bp, Homo sapiens
  Payload ID: 6635
  Gene Symbol: GRK4
  Gene Name: G protein-coupled receptor kinase 4
  Uniprot ID: P32298
  ENST ID: ENST00000345167
  CDS Start-End: 251-1891
ccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 136069 - DNA, 2068 bp, Homo sapiens
  Payload ID: 6635
  Gene Symbol: GRK4
  Gene Name: G protein-coupled receptor kinase 4
  Uniprot ID: P32298
  ENST ID: ENST00000398051
  CDS Start-End: 464-1966
ttcagctaagccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaaca

SEQ ID NO: 136070 - DNA, 2202 bp, Homo sapiens
  Payload ID: 6635
  Gene Symbol: GRK4
  Gene Name: G protein-coupled receptor kinase 4
  Uniprot ID: P32298
  ENST ID: ENST00000398052
  CDS Start-End: 344-2080
cagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 136071 - DNA, 2136 bp, Homo sapiens
  Payload ID: 6635
  Gene Symbol: GRK4
  Gene Name: G protein-coupled receptor kinase 4
  ENST ID: ENST00000503518
  CDS Start-End: 438-692
cgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagtcctctgcatcccgccacaaaagcatcagttggtccagcccttcagcgggagacccccacaatcctctgtgcaatcctctgtctcggacctcatgtctcccttgcctgcgtctcaagagagctggcgacagagcctcggacctcaagtccctgtgctagccacggtagttcttcacaccccgtcactcttacggaattgctgatttcctctatttccttgcgtgatggagcagctctgctcggactgtgctccaggacagtgtaaatgccgactgaagatgccacagcagccggcgatgcatatttaaaggacagtctggagccgaaggtggcggccacgcttgtagtcccagctactctggaagctgaggtggaaggctcacttgggcccaggagagtccagcctgggcaaaacacagcaagaccatctctttaaaaaagtctaaaacaaagacttcatcttctcagtatttttgtgcaccaactcacactattttgaatagaagaactgagaatgggtgggaagagaatgggatctttttcccttaagataatcagggagtcccagagcagtatgcgttctcagcagccattttcagtggagcatttgactgtgcctcttatccctgactgtgaactccaaataggtcatggaaaataatcatccttagtggaagtcagattgaagctaagccagttttctttttacactaccttcctatctgcatgtaatttacaaaaaggaactataccaagccgccttccttataatgctgcagagattagataatgagataaatacaagtgctctataaatgctaaataacataaaaccagattctgtcacaaaacctaagaccacagtgatagtttgaaaaatgaaagttttggccgggcacggtggctcacagctgtaatcccagcacttttggaggccgaggcgggcggatcacaaggtcaggagattgagaccatcctggctaacatggtgaaaccccgtctctactaaaaatacaaaaattagccgggcgtggtggcgggcgcctgtagtcccagctacatgggaggctgaggcaggagaatggcgtgaaccctggaggcagagcttgcagtgagccgagatcgcgccacggcactccagcctgggtgacagagcgagactccgtctcgaaaaaaaaaaaaaagaaagttttaattttttccctgaaatatctcatattaactccacagtagtgtgattatgaggcctgtccccattgagtgagagtatttgctcctgtggtcagaaagcatcattatgtatagcttgattaatggttagagaagttgaatatataatattagatatacatggatacatgctgagtattggttataatttagggctttttcccaagttgatgactgtgtttgttactttaaagtatctcccaggaagtaccaggaggtgtcttcttggacacataacttcatggacagctccttgtttagcttcactggctcatatactagaaaattaacctttgaaatgaatgaacgtagcacaagagttatattctggtcctgagaagcgcaatgttgatttaatattattagtgagtccggtcatttcctggatttatttcaaatagaatcagtcagtctcaa

SEQ ID NO: 136072 - DNA, 1971 bp, Homo sapiens
  Payload ID: 6635
  Gene Symbol: GRK4
  Gene Name: G protein-coupled receptor kinase 4
  Uniprot ID: P32298
  ENST ID: ENST00000504933
  CDS Start-End: 251-1849
ccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 136073 - DNA, 2654 bp, Homo sapiens
  Payload ID: 6636
  Gene Symbol: GRK5
  Gene Name: G protein-coupled receptor kinase 5
  Uniprot ID: P34947
  ENST ID: ENST00000392870
  CDS Start-End: 330-2102
aaagcatccgagggagccggaggggaggagaatggagtgacagagacacgcggagggtggggggtgggggggagcgtgttgagggaggggggaggggggacacagagggaggaagaagcggcggcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccata

SEQ ID NO: 136074 - DNA, 2939 bp, Homo sapiens
  Payload ID: 6637
  Gene Symbol: GRK6
  Gene Name: G protein-coupled receptor kinase 6
  Uniprot ID: P43250
  ENST ID: ENST00000355472
  CDS Start-End: 169-1899
agagtgcgcggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttatta

SEQ ID NO: 136075 - DNA, 1789 bp, Homo sapiens
  Payload ID: 6637
  Gene Symbol: GRK6
  Gene Name: G protein-coupled receptor kinase 6
  Uniprot ID: P43250
  ENST ID: ENST00000355958
  CDS Start-End: 4-1686
cccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaaaggtgagcagtgtgggctccccgtgggttggccttgctgcctggcctcggggagccacgggcagcccttccatggcaaaggcaagatgtgggagaaagaagtctggtgc

SEQ ID NO: 136076 - DNA, 2792 bp, Homo sapiens
  Payload ID: 6637
  Gene Symbol: GRK6
  Gene Name: G protein-coupled receptor kinase 6
  ENST ID: ENST00000393576
  CDS Start-End: 53-1681
gcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaagctgccacatgtctctgtgtgaatagtccgagcacaaacctggctagccgcc

SEQ ID NO: 136077 - DNA, 955 bp, Homo sapiens
  Payload ID: 6637
  Gene Symbol: GRK6
  Gene Name: G protein-coupled receptor kinase 6
  ENST ID: ENST00000506296
  CDS Start-End: 197-955
ccgggttcctgtagccacacgacggggcgccgttagagcgccgggagcccggagccctggggcggaggggtcacccagccccacgcggcgcaccggcagaaggcgtggccgcccagtccccagttccgcgcttgctcggcagtcacgttccggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaa

SEQ ID NO: 136078 - DNA, 336 bp, Homo sapiens
  Payload ID: 6637
  Gene Symbol: GRK6
  Gene Name: G protein-coupled receptor kinase 6
  ENST ID: ENST00000512684
  CDS Start-End: 285-336
cgagaacatcgtagcgaacacggtgctactcaaggcccgggaaggagcctgaagcaggagaagcacgtgtgtcctggaacgcagcaagggcgtgctggagcgtgcagagggaaggcctgaggtgctgttctgcctcagctctgccttggctgggccctagaggccgtggaccgcactgaggacccagaggcagttctgaggcagtgggactcgagacccagtgtcctattgctcccacaggtggcggtggaaatcgcaaaggcaaaagcaagaaatggcggcagatgctccagttccctcacatcagccagtgcgaagagctgcggctcagcctcg

SEQ ID NO: 136079 - DNA, 557 bp, Homo sapiens
  Payload ID: 6637
  Gene Symbol: GRK6
  Gene Name: G protein-coupled receptor kinase 6
  ENST ID: ENST00000502598
  CDS Start-End: 368-557
agtgatcaaaggtctcctcccctacccctgcccctagcagttgtgcctaccctcgaactggtggccccagccggccacctggcagagcgtggtctcggagggtcgcgcggcgccgcttggcaggcacaccggctgaacgtaaggcgacaggagcgcgcagctgccgtccgcatcctcctgaaggcgcaacagagctaacccgggcggagaggagcgtgaggcggggacgccggggccccaagctctcttcccgtccccgcggggcgcccccacgcacccaggtcgtgctggtagctgacgggcgagaaggcctcgtgcaagcggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatg

SEQ ID NO: 136080 - DNA, 744 bp, Homo sapiens
  Payload ID: 6637
  Gene Symbol: GRK6
  Gene Name: G protein-coupled receptor kinase 6
  ENST ID: ENST00000508705
  CDS Start-End: 1-267
gccgagtatgaagtgaccccggatgacaagcggaaggcatgtgggcggcagctaacgcagaattttctgagccacacggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtg

SEQ ID NO: 136081 - DNA, 555 bp, Homo sapiens
  Payload ID: 6637
  Gene Symbol: GRK6
  Gene Name: G protein-coupled receptor kinase 6
  ENST ID: ENST00000511244
  CDS Start-End: 169-555
gattggtcccgcccccgtacttctttgagcgagtccccagctgggggggcgggggaaaaaatgaagaggaagactaatgggaagacggcgcggggagcttctgcccggtgattggtcaaatgaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactac

SEQ ID NO: 136082 - DNA, 1660 bp, Homo sapiens
  Payload ID: 6637
  Gene Symbol: GRK6
  Gene Name: G protein-coupled receptor kinase 6
  ENST ID: ENST00000507633
  CDS Start-End: 102-1529
gccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacgtgagtgcagcccactcctgctgagggcggggcccagccagggctggggctcaggggctcttgtagtatcagccaggatgcttccagtgcaagtggcagaaaaaacaatctagtggcttagccacagaaataaagataattcacaaaaaggaaaa

SEQ ID NO: 136083 - DNA, 2571 bp, Homo sapiens
  Payload ID: 6637
  Gene Symbol: GRK6
  Gene Name: G protein-coupled receptor kinase 6
  Uniprot ID: P43250
  ENST ID: ENST00000528793
  CDS Start-End: 4-1773
cccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaaaggattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataa

SEQ ID NO: 136084 - DNA, 3239 bp, Homo sapiens
  Payload ID: 6638
  Gene Symbol: GRK7
  Gene Name: G protein-coupled receptor kinase 7
  Uniprot ID: Q8WTQ7
  ENST ID: ENST00000264952
  CDS Start-End: 138-1799
accctccacgggtcccacccacaggccacaggactcactgtaaatcccttggacgttgtctcacccgggaagggaaagcagccagcagccctccagccctcttgtgctttccctgggagtgcgccccgtgctcagccatggtggacatgggggccctggacaacctgatcgccaacaccgcctacctgcaggcccggaagccctcggactgcgacagcaaagagctgcagcggcggcggcgtagcctggccctgcccgggctgcagggctgcgcggagctccgccagaagctgtccctgaacttccacagcctgtgtgagcagcagcccatcggtcgccgcctcttccgtgacttcctagccacagtgcccacgttccgcaaggcggcaaccttcctagaggacgtgcagaactgggagctggccgaggagggacccaccaaagacagcgcgctgcaggggctggtggccacttgtgcgagtgcccctgccccggggaacccgcaacccttcctcagccaggccgtggccaccaagtgccaagcagccaccactgaggaagagcgagtggctgcagtgacgctggccaaggctgaggccatggctttcttgcaagagcagccctttaaggatttcgtgaccagcgccttctacgacaagtttctgcagtggaaactcttcgagatgcaaccagtgtcagacaagtacttcactgagttcagagtgctggggaaaggtggttttggggaggtatgtgccgtccaggtgaaaaacactgggaagatgtatgcctgtaagaaactggacaagaagcggctgaagaagaaaggtggcgagaagatggctctcttggaaaaggaaatcttggagaaggtcagcagccctttcattgtctctctggcctatgcctttgagagcaagacccatctctgccttgtcatgagcctgatgaatgggggagacctcaagttccacatctacaacgtgggcacgcgtggcctggacatgagccgggtgatcttttactcggcccagatagcctgtgggatgctgcacctccatgaactcggcatcgtctatcgggacatgaagcctgagaatgtgcttctggatgacctcggcaactgcaggttatctgacctggggctggccgtggagatgaagggtggcaagcccatcacccagagggctggaaccaatggttacatggctcctgagatcctaatggaaaaggtaagttattcctatcctgtggactggtttgccatgggatgcagcatttatgaaatggttgctggacgaacaccattcaaagattacaaggaaaaggtcagtaaagaggatctgaagcaaagaactctgcaagacgaggtcaaattccagcatgataacttcacagaggaagcaaaagatatttgcaggctcttcttggctaagaaaccagagcaacgcttaggaagcagagaaaagtctgatgatcccaggaaacatcatttctttaaaacgatcaactttcctcgcctggaagctggcctaattgaacccccatttgtgccagacccttcagtggtttatgccaaagacatcgctgaaattgatgatttctctgaggttcggggggtggaatttgatgacaaagataagcagttcttcaaaaactttgcgacaggtgctgttcctatagcatggcaggaagaaattatagaaacgggactgtttgaggaactgaatgaccccaacagacctacgggttgtgaggagggtaattcatccaagtctggcgtgtgtttgttattgtaaattgctctctttaccagacaggcagcaggagtctcggctgacataatcctcgaatgttccacacgtggaaatctgtggaatgagggctaatcagttaggagggacatcacaaccacaaaacaattcaaaagacaggcaagctcactactagaacacattttattttctttttctttcttcataaagatgagtaaagtctcagttttcactgagggcagggaaaaggaacactcaggtttattttgataaactgaaagcatcagccttttaccatcatgtccctgtgtattacgcaaagtcctaggaacagagaatggaactttgtggtgtgcccagaaaatgagcatttgcaattcttagtaaataatcattttagtttttctttgtttatatctttttttcccttcatctttcttcgcttctatacttataaaaaggattttgaagctggaaacaaatgtttctgacattctccccctaaaaaggagtggattacaatattttggcaatgttttaaatcacagaataattttcaatttcagtgacagtttcttttgcaattttgtggaaataatttactatcataatgttgaagcattttaaacataaacatccatgacatctgtgaattaaagcattctgtaaatttagttgagtcctttaagtaatatggtacaaattgcttcaacttgcactaccatatgccatcggttcccaaactctgctgaactttggaatcatctagggatcttttaaaaaactaatgcctgattcccatccatagacattctgatccccactcccaggtatgagaacagcttgaccatttagaatttcagaagctccccaggtgattctaatgtgcagcagagtttggcaggcactgctgtgcacatttgaatgttattacattcaatcttattttggttgctcaaaacttcaatcatacattttgatggcaacttttcaaatgtccccaaagcatgtcattttagtaattgcagtataaatgaaacaagacagtctattcatcttatggcttctcttgtccttgcacactttagtttctcacacgtatcttgggagctcggtctcttggctatttcaagtcctgaaggagacctatgggcttagaaattgagttgaacaggccaggtgcggtggctcatgcctgcaattccagcactttgggaggccaaggcagatggatcatgaggtcaggggctcaagactagcctggccaacatgttgtaaaccccgtctctactaaaaatacaaaaattagcccggtgtggtggtgcacatctataatcccagttacccgggagcctgaggcaggagaattgcttgaacccaggaggcggaggttgtagtgagccaagatcgcaacattgcactccaggctgggcagcaagagcaagactctatctcaaaaaaaaa

SEQ ID NO: 136085 - DNA, 3768 bp, Homo sapiens
  Payload ID: 6639
  Gene Symbol: GIT1
  Gene Name: G protein-coupled receptor kinase interacting ArfGAP 1
  Uniprot ID: Q9Y2X7
  ENST ID: ENST00000225394
  CDS Start-End: 250-2535
agggggcggagagaggagccgcgagcggcggcggggcggcgcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatgagctgtt

SEQ ID NO: 136086 - DNA, 660 bp, Homo sapiens
  Payload ID: 6639
  Gene Symbol: GIT1
  Gene Name: G protein-coupled receptor kinase interacting ArfGAP 1
  ENST ID: ENST00000335356
  CDS Start-End: 219-660
cggggcggcgcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccgggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctggg

SEQ ID NO: 136087 - DNA, 3711 bp, Homo sapiens
  Payload ID: 6639
  Gene Symbol: GIT1
  Gene Name: G protein-coupled receptor kinase interacting ArfGAP 1
  Uniprot ID: Q9Y2X7
  ENST ID: ENST00000394869
  CDS Start-End: 172-2484
gcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagatctcggcaaaagtgcatgtctcagagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 136088 - DNA, 2827 bp, Homo sapiens
  Payload ID: 6639
  Gene Symbol: GIT1
  Gene Name: G protein-coupled receptor kinase interacting ArfGAP 1
  ENST ID: ENST00000581348
  CDS Start-End: 54-2297
cgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagatctcggcaaaagtgcatgtctcagagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccgggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctg

SEQ ID NO: 136089 - DNA, 555 bp, Homo sapiens
  Payload ID: 6639
  Gene Symbol: GIT1
  Gene Name: G protein-coupled receptor kinase interacting ArfGAP 1
  ENST ID: ENST00000578266
  CDS Start-End: 1-534
gagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaaggtacaggggccaaagagaggaccaggagtgggagggcctcgagctggggcaggcgtggagaatcccatctgatcgctacctgggtggagacac

SEQ ID NO: 136090 - DNA, 686 bp, Homo sapiens
  Payload ID: 6639
  Gene Symbol: GIT1
  Gene Name: G protein-coupled receptor kinase interacting ArfGAP 1
  ENST ID: ENST00000585148
  CDS Start-End: 1-686
gatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcaacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccc

SEQ ID NO: 136091 - DNA, 918 bp, Homo sapiens
  Payload ID: 6639
  Gene Symbol: GIT1
  Gene Name: G protein-coupled receptor kinase interacting ArfGAP 1
  ENST ID: ENST00000578670
  CDS Start-End: 1-449
cggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccgggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtggggggg

SEQ ID NO: 136092 - DNA, 2798 bp, Homo sapiens
  Payload ID: 6639
  Gene Symbol: GIT1
  Gene Name: G protein-coupled receptor kinase interacting ArfGAP 1
  ENST ID: ENST00000579937
  CDS Start-End: 215-2299
gcggcgcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagctggtggcttaaagtccaaggtccagcctcactcctgccccctccagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcc

SEQ ID NO: 136093 - DNA, 547 bp, Homo sapiens
  Payload ID: 6639
  Gene Symbol: GIT1
  Gene Name: G protein-coupled receptor kinase interacting ArfGAP 1
  ENST ID: ENST00000577466
  CDS Start-End: 391-547
atgggccctggggactgcatatcccagaggggtaaggatgtaggaaagggcatggctctgtcagcccccagctgtgagctcttggggagatccctcactggtaacctggccgtagtgatggtcccagctcctaggctgttggagactgagtgagtgaatgtgtggagagtactaggcttggcacgggccagagcaggtgctcaggaggtctggcccatcatctggctccggctgacccttgccctcaccctggcagaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctgg

SEQ ID NO: 136094 - DNA, 546 bp, Homo sapiens
  Payload ID: 6639
  Gene Symbol: GIT1
  Gene Name: G protein-coupled receptor kinase interacting ArfGAP 1
  ENST ID: ENST00000583413
  CDS Start-End: 26-546
tggctggggcggactctcccaccacatggaacaccgacacagcccgcagcccctccctgcagccctcactgccccggcggaggaggggcacagaggcctctactctcatctagaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttctt

SEQ ID NO: 136095 - DNA, 2094 bp, Homo sapiens
  Payload ID: 6640
  Gene Symbol: GIT2
  Gene Name: G protein-coupled receptor kinase interacting ArfGAP 2
  ENST ID: ENST00000320063
  CDS Start-End: 68-1333
cgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctttttttttttacaaagtgctgaattgtttggaatatcaagagtattatgtaataaaaacttgttgatcataa

SEQ ID NO: 136096 - DNA, 5387 bp, Homo sapiens
  Payload ID: 6640
  Gene Symbol: GIT2
  Gene Name: G protein-coupled receptor kinase interacting ArfGAP 2
  ENST ID: ENST00000354574
  CDS Start-End: 166-2211
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagaaggagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 136097 - DNA, 5466 bp, Homo sapiens
  Payload ID: 6640
  Gene Symbol: GIT2
  Gene Name: G protein-coupled receptor kinase interacting ArfGAP 2
  Uniprot ID: Q14161
  ENST ID: ENST00000355312
  CDS Start-End: 1-2280
atgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaa

SEQ ID NO: 136098 - DNA, 5444 bp, Homo sapiens
  Payload ID: 6640
  Gene Symbol: GIT2
  Gene Name: G protein-coupled receptor kinase interacting ArfGAP 2
  Uniprot ID: Q14161
  ENST ID: ENST00000361006
  CDS Start-End: 81-2270
gttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtg

SEQ ID NO: 136099 - DNA, 5291 bp, Homo sapiens
  Payload ID: 6640
  Gene Symbol: GIT2
  Gene Name: G protein-coupled receptor kinase interacting ArfGAP 2
  Uniprot ID: Q14161
  ENST ID: ENST00000457474
  CDS Start-End: 72-2117
gaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagacggctcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtg

SEQ ID NO: 136100 - DNA, 2424 bp, Homo sapiens
  Payload ID: 6640
  Gene Symbol: GIT2
  Gene Name: G protein-coupled receptor kinase interacting ArfGAP 2
  Uniprot ID: Q14161
  ENST ID: ENST00000553118
  CDS Start-End: 166-2061
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaa

SEQ ID NO: 136101 - DNA, 2127 bp, Homo sapiens
  Payload ID: 6640
  Gene Symbol: GIT2
  Gene Name: G protein-coupled receptor kinase interacting ArfGAP 2
  ENST ID: ENST00000551209
  CDS Start-End: 1-2127
atgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactga

SEQ ID NO: 136102 - DNA, 2989 bp, Homo sapiens
  Payload ID: 6640
  Gene Symbol: GIT2
  Gene Name: G protein-coupled receptor kinase interacting ArfGAP 2
  Uniprot ID: Q14161
  ENST ID: ENST00000547815
  CDS Start-End: 73-1488
ggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctttttttttttacaaagtgctgaattgtttggaatatcaagagtattatgtaataaaaacttgttgatcataatttttcttgttggctttttggaaagcaataggcgatctgatttttcacaagctgaacttctgtctttcttgctttgcaaagcaaccctagtcatctttgtgctgcttccatggtgtctgctgtcatttttggcctttacaaattgctcagggctcatttgaaaagcaagttacctaaatgatgttttaatgatctcgaactcttgcttgaaacagccttagtaataatccagtgtacagcttgcctgcaaacatttcccagccccaccatgacaaattttaaagtggttagacattttgttttgaggaagtccaaaccacaacttttccacattcagaaatgaagctatttaatttgcttacgtgatgaagggagttgattgtgtttcacccaatccagaagaaagggtccttgtttgtattggctttttactttcagcccggctagctgttactgtccttattgtttaaaactggtagttgtattcatttacttggtgtttgctttttctgcttgctgtaaaaaaacacagtcccactgccaaacatttctttcagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatat

SEQ ID NO: 136103 - DNA, 1977 bp, Homo sapiens
  Payload ID: 6640
  Gene Symbol: GIT2
  Gene Name: G protein-coupled receptor kinase interacting ArfGAP 2
  ENST ID: ENST00000550186
  CDS Start-End: 53-1977
atgtcgaaacggctccggagcagcgaggtgtgcgctgactgcagcgggccggatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagca

SEQ ID NO: 136104 - DNA, 7362 bp, Homo sapiens
  Payload ID: 6641
  Gene Symbol: GPRC5A
  Gene Name: G protein-coupled receptor, class C, group 5, member A
  Uniprot ID: Q8NFJ5
  ENST ID: ENST00000014914
  CDS Start-End: 891-1964
aatttcatctggcgcccccgttcaatcagcctgcattgtcgaggctttaggagaggcagttaggaaaggagagatactgatctctcagccccagggcagcactaatggtgcctgtctagactctgacaggtggagctgctgagctaactacggacctggtgggggaagttttccttggctttcacgtggctttggctggggagccctgagaaggtggctgcctcctttttctgaagcctggcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctctctctctctctctctctctttctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactctggatcggcatttttttttttttttttttttgagacagggtctagctctatggcccaggctggagtgcagtggcacaatcatagctcactgcagcctcaactttctgtgctcgagtgattctcctgcctcagtctcctgagtagctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttgttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaagaa

SEQ ID NO: 136105 - DNA, 529 bp, Homo sapiens
  Payload ID: 6641
  Gene Symbol: GPRC5A
  Gene Name: G protein-coupled receptor, class C, group 5, member A
  ENST ID: ENST00000540125
  CDS Start-End: 1-201
cccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaa

SEQ ID NO: 136106 - DNA, 897 bp, Homo sapiens
  Payload ID: 6641
  Gene Symbol: GPRC5A
  Gene Name: G protein-coupled receptor, class C, group 5, member A
  ENST ID: ENST00000534831
  CDS Start-End: 77-897
gaggtgagcagctctgggatcactctgcaggaaaagaatagagggagaaagatctcagaggacccgaaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccc

SEQ ID NO: 136107 - DNA, 5213 bp, Homo sapiens
  Payload ID: 6642
  Gene Symbol: GPRC5B
  Gene Name: G protein-coupled receptor, class C, group 5, member B
  Uniprot ID: Q9NZH0
  ENST ID: ENST00000300571
  CDS Start-End: 193-1404
gggccgcggccgctgcagcagcgcgggccgggccagggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaggccctagtctctgctgtctcccctccccaccccatccttgcaaagcactggggaaagtaaggccaatctggccctccctgtgtgacccgccttcgagttttccttaacagttagtacatttccttgtgttaccacgcatggggaagaaaacgcatggccccagaatgccacccccacctgacctccccggaagcaccccgcctctgcccagagcatgtgcttgcttctagagaatcccgttccagtcattgcgtggacagaaaacgtaagagtcctggggaggggtgggagggaatgaagctaggacctggggtgggggtgggggcggttgcatgcggacccggtattctgaaaagaaagaaatcttcaaacacctcggtcctgtccggtgaaaaaacgacagcattacacattctcgtgccaggaaatggttactcacccccgctctctggagtcctttggagctttctgataccattcacacgatggagcaattcacacgttcgttttctaagttctttattgtccaagcatataaggtgagcacagcacaaatggctgccatggaaagtcgtgcttccccagcataagaacagagccatctttgagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagatgccgtcaggacccactgaacaagggtgaactcgggtggtggtctcggttggccaaggctgagttgaacgcctcaggccaaaccccaagttgaaagggagcattgtggcttttataatccaatgatgcaatgatgataccagcttacaggagttctcagcaggtgctttttattaactgatgaagagctaaggctcacttttgatagataatatatatttattaaatgcattaatgtgtgttttataatgtacctttatcttcccccggctgactgttgcatacttataaaaaagaagttaaagaaatttcaagacaatcaatatgtaccataaacgactatataaatattacaaatttaaaaggctgtaaaccatgggcagataggttttattttcaaaatgctgttcttaacacaaaaataaaggctttactatttacttaagacgtgtggtagcttgtcaaaacaacccagtgcaactaactactaggctttcggatctgccttgagggtcggtctgtggcattttaaatgggagaatcttggttaacagcaaaccacagaacatattaaggtaataagtttacccataaaagcaggaactttctatataatactttgggacttagacaacaaaaatcctttgttacatctgtctgggtttaagtgtctcatcttgttgggtttgcagtaaaagttaaggagtggtctcctttggaaatgatcattaagtataaggtcttttttataaagagagtagtcagtcactaggtaaacttaaaaccaaattcagaggttggggacttaaattagaatatggatctttgcaaaggcggccacaagtgggaaaactggtaataagagcacttctgtattccttgggactagagttcattgtacattttaacagcagctggtgtagaagaatactcctgaggcactgaagaagtaatctggatgaatgaataaaatgtggggataatgcagaaagtgaagactggtcctttcttttctaaactatttgcattaaagcttgtttgcaatgaa

SEQ ID NO: 136108 - DNA, 1215 bp, Homo sapiens
  Payload ID: 6642
  Gene Symbol: GPRC5B
  Gene Name: G protein-coupled receptor, class C, group 5, member B
  Uniprot ID: Q9NZH0
  ENST ID: ENST00000535671
  CDS Start-End: 1-1215
atgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccgaaatggttactcacccccgctctctggagtcctttggagctttctga

SEQ ID NO: 136109 - DNA, 763 bp, Homo sapiens
  Payload ID: 6642
  Gene Symbol: GPRC5B
  Gene Name: G protein-coupled receptor, class C, group 5, member B
  ENST ID: ENST00000566822
  CDS Start-End: 231-763
actgtggatcgggcagccaaggatgcaatttgcatttcaatgattgcttttatttacaggactggagctgctttgcatattcatggatcacagagcttgtgttcttgcaaccctgtttactaacctatgaggattttttaatttgagagccctcaaatgggccagtggtctagtcagcattgggaaatgaagatgatgagatcctgtaactcggaaaagatatcagaggaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgt

SEQ ID NO: 136110 - DNA, 2984 bp, Homo sapiens
  Payload ID: 6642
  Gene Symbol: GPRC5B
  Gene Name: G protein-coupled receptor, class C, group 5, member B
  Uniprot ID: Q9NZH0
  ENST ID: ENST00000569479
  CDS Start-End: 244-1455
atctggaagggccacggtccccaaagatcaggggctgccactattcccagaaggaggtgttctgcatctccccttcctgcagcccccgggagaggggagcaggggtccgtcctatcccttttggtcttatgtggctgggatggttgcggcgacgggggtagagattggggggcgcaccgcggagggagaaaggaaatctcaccctgagaatctggagtgcagggaagggatgctgctcaaagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 136111 - DNA, 818 bp, Homo sapiens
  Payload ID: 6642
  Gene Symbol: GPRC5B
  Gene Name: G protein-coupled receptor, class C, group 5, member B
  ENST ID: ENST00000562469
  CDS Start-End: 374-818
tgcagcagcgcgggccgggccagggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcggactggagctgctttgcatattcatggatcacagagcttgtgttcttgcaaccctgtttactaacctatgaggattttttaatttgagagccctcaaatgggccagtggtctagtcagcattgggaaatgaagatgatgagatcctgtaactcggaaaagatatcagaggtgcctaccgccatctttagagaagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcgga

SEQ ID NO: 136112 - DNA, 568 bp, Homo sapiens
  Payload ID: 6642
  Gene Symbol: GPRC5B
  Gene Name: G protein-coupled receptor, class C, group 5, member B
  ENST ID: ENST00000570142
  CDS Start-End: 310-568
agcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcggactggagctgctttgcatattcatggatcacagagcttgtgttcttgcaaccctgtttactaacctatgaggattttttaatttgagagccctcaaatgggccagtggtctagtcagcattgggaaatgaagatgatgagatcctgtaactcggaaaagatatcagaggaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggaga

SEQ ID NO: 136113 - DNA, 571 bp, Homo sapiens
  Payload ID: 6642
  Gene Symbol: GPRC5B
  Gene Name: G protein-coupled receptor, class C, group 5, member B
  ENST ID: ENST00000564449
  CDS Start-End: 495-571
gtgtttcgaggggccaaggaagcgggtgttggtcccagtgtgcgtaaacggacaacgacatctgggagttgggcagtgaggagagagaagagtgtgtccaggaggaacctgcctggaggaggcctagcggtgtgtgtgcgcctaggtgtataccggggcgttggtgacttcgagaggcaccgggcgggatcgatcctctctgcgtcctggacctggtgctggtgtgtttcggggaagttactgcttatgaaccccccttggagcgtggcctgggggcaggaaggcttccgcgctgggacccctgggtcgcgatacctccctcggactggagctgctttgcatattcatggatcacagagcttgtgttcttgcaaccctgtttactaacctatgaggattttttaatttgagagccctcaaatgggccagtggtctagtcagcattgggaaatgaagatgatgagatcctgtaactcggaaaagatatcagaggaatgttcgtggcatcagagagaaagatgagagctcaccaggtgctcaccttcctcctgctcttcgtgatcacctcggt

SEQ ID NO: 136114 - DNA, 568 bp, Homo sapiens
  Payload ID: 6642
  Gene Symbol: GPRC5B
  Gene Name: G protein-coupled receptor, class C, group 5, member B
  ENST ID: ENST00000568214
  CDS Start-End: 299-568
cacggtccccaaagatcaggggctgccactattcccagaaggaggtgttctgcatctccccttcctgcagcccccgggagaggggagcaggggtccgtcctatcccttttggtcttatgtggctgggatggttgcggcgacgggggtagagattggggggcgcaccgcggagggagaaaggaaatctcaccctgagaatctggagtgcagggaagggatgctgctcaaagtatttactaaacatcgtgccaggtgctgtgtgtcgagcttgagtctacagccatggttctcatccagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaag

SEQ ID NO: 136115 - DNA, 1830 bp, Homo sapiens
  Payload ID: 6642
  Gene Symbol: GPRC5B
  Gene Name: G protein-coupled receptor, class C, group 5, member B
  Uniprot ID: Q9NZH0
  ENST ID: ENST00000569847
  CDS Start-End: 527-1738
aagcaggtcccacggccgcccagcggacacgcgtccgggctgtgccctgaccgtctgcggagcgcacggccagtggcccgggccgctgagtgtgtgagccctgaagggcagtggacatgtgcgtacgtgggtgatgtgtgcggtaggggtggtggcgatcctgcgtagggacccacgtgaggggtgcaccgactggacgtgtgtgtttcgaggggccaaggaagcgggtgttggtcccagtgtgcgtaaacggacaacgacatctgggagttgggcagtgaggagagagaagagtgtgtccaggaggaacctgcctggaggaggcctagcggtgtgtgtgcgcctaggtgtataccggggcgttggtgacttcgagaggcaccgggcgggatcgatcctctctgcgtcctggacctggtgctggtgtgtttcggggaagttactgcttatgaaccccccttggagcgtggcctgggggcaggaaggcttccgcgctgggacccctgggtcgcgatacctccctcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccg

SEQ ID NO: 136116 - DNA, 1273 bp, Homo sapiens
  Payload ID: 6643
  Gene Symbol: GPRC5C
  Gene Name: G protein-coupled receptor, class C, group 5, member C
  ENST ID: ENST00000342648
  CDS Start-End: 492-872
agagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 136117 - DNA, 2988 bp, Homo sapiens
  Payload ID: 6643
  Gene Symbol: GPRC5C
  Gene Name: G protein-coupled receptor, class C, group 5, member C
  ENST ID: ENST00000392627
  CDS Start-End: 1127-2587
aaacactccgggccgcccgccccgccaccagctggctccgaccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 136118 - DNA, 1529 bp, Homo sapiens
  Payload ID: 6643
  Gene Symbol: GPRC5C
  Gene Name: G protein-coupled receptor, class C, group 5, member C
  ENST ID: ENST00000392628
  CDS Start-End: 1-1387
aaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgg

SEQ ID NO: 136119 - DNA, 1419 bp, Homo sapiens
  Payload ID: 6643
  Gene Symbol: GPRC5C
  Gene Name: G protein-coupled receptor, class C, group 5, member C
  Uniprot ID: Q9NQ84
  ENST ID: ENST00000392629
  CDS Start-End: 58-1419
ggggaacctccctgaagagtgccctggtcacagcacccttgaagacagccattggccatggggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactga

SEQ ID NO: 136120 - DNA, 1592 bp, Homo sapiens
  Payload ID: 6643
  Gene Symbol: GPRC5C
  Gene Name: G protein-coupled receptor, class C, group 5, member C
  ENST ID: ENST00000481232
  CDS Start-End: 512-964
agaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 136121 - DNA, 584 bp, Homo sapiens
  Payload ID: 6643
  Gene Symbol: GPRC5C
  Gene Name: G protein-coupled receptor, class C, group 5, member C
  ENST ID: ENST00000582473
  CDS Start-End: 124-584
agcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctgga

SEQ ID NO: 136122 - DNA, 1554 bp, Homo sapiens
  Payload ID: 6643
  Gene Symbol: GPRC5C
  Gene Name: G protein-coupled receptor, class C, group 5, member C
  ENST ID: ENST00000581590
  CDS Start-End: 1-1066
caacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggatgacgaccagagcagctctctggagaggtgccctgtagtcagtcccacagctctctggtgctacccccgtccccagcagcctgtgcctttgtcactggcatacttttccagagctaaattgggcgagcaatccctgcagagtaggattgcagctctgactgtggcccccgacctctctgtgttgcctgtcgaagtccatgaacagaatgttatttccctccagtggaagggaagcagggagctctgtggacctcacgctgcccttggtctagcttagcggccccaagatcccttagtgaatcaaggcgctgtgttgctttcctatgtgataatttcaaaggagtccccggcagggcctgatacccagaggctgcagtctccagtggacgtgggtgtgtgtatagcctgagtcctctgggggtctgcgcgtgaggctcagggagggatgggatcctaaaagatgcaggcctgcctgtattcaggagtacccactggccctgcttactcccgcccgggccaagtggagaagaagttagatgagttcttaggaggagagaggcagcttctttgaggtggtcgagtggcatcacaaacaagcgttgaatggaaaaagactagaagaggcagagcctgtcacaggttcaccatcatccagccaacactatgggaaatctcacacccaccactgtcaaaccgaggactttggacttaataactgctcagaattaaacgaccttaccttccatgggtgagggcttactgcca

SEQ ID NO: 136123 - DNA, 550 bp, Homo sapiens
  Payload ID: 6643
  Gene Symbol: GPRC5C
  Gene Name: G protein-coupled receptor, class C, group 5, member C
  ENST ID: ENST00000582444
  CDS Start-End: 115-550
ctgccggggacagctgggactggacaccacccagaagccagctggctggccctgccctgccctgctggaggcaccatctctgggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggccc

SEQ ID NO: 136124 - DNA, 1038 bp, Homo sapiens
  Payload ID: 6644
  Gene Symbol: GPRC5D
  Gene Name: G protein-coupled receptor, class C, group 5, member D
  Uniprot ID: Q9NZD1
  ENST ID: ENST00000228887
  CDS Start-End: 1-1038
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagcccgagacagtgatggagctgaggaggatgtagcattaacttcatatggtactcccattcagccgcagactgttgatcccacacaagagtgtttcatcccacaggctaaactaagcccccagcaagatgcaggaggagtataa

SEQ ID NO: 136125 - DNA, 903 bp, Homo sapiens
  Payload ID: 6644
  Gene Symbol: GPRC5D
  Gene Name: G protein-coupled receptor, class C, group 5, member D
  Uniprot ID: Q9NZD1
  ENST ID: ENST00000396333
  CDS Start-End: 1-903
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagactgttga

SEQ ID NO: 136126 - DNA, 448 bp, Homo sapiens
  Payload ID: 6644
  Gene Symbol: GPRC5D
  Gene Name: G protein-coupled receptor, class C, group 5, member D
  ENST ID: ENST00000541128
  CDS Start-End: 87-448
ccagcactacagcctaagcttccagagtggacacggagaagggcatcagaaaaccattctggtgaggtccacacccataagtcaccatgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttg

SEQ ID NO: 136127 - DNA, 2860 bp, Homo sapiens
  Payload ID: 6645
  Gene Symbol: GPRC6A
  Gene Name: G protein-coupled receptor, class C, group 6, member A
  Uniprot ID: Q5T6X5
  ENST ID: ENST00000310357
  CDS Start-End: 23-2803
actgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaatgagttcaggaatcttaagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaataaaatgtttccagggtctttgcatct

SEQ ID NO: 136128 - DNA, 2622 bp, Homo sapiens
  Payload ID: 6645
  Gene Symbol: GPRC6A
  Gene Name: G protein-coupled receptor, class C, group 6, member A
  Uniprot ID: Q5T6X5
  ENST ID: ENST00000368549
  CDS Start-End: 25-2592
gaactgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaa

SEQ ID NO: 136129 - DNA, 2310 bp, Homo sapiens
  Payload ID: 6645
  Gene Symbol: GPRC6A
  Gene Name: G protein-coupled receptor, class C, group 6, member A
  Uniprot ID: Q5T6X5
  ENST ID: ENST00000530250
  CDS Start-End: 25-2280
gaactgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaatgagttcaggaatcttaagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaa

SEQ ID NO: 136130 - DNA, 866 bp, Homo sapiens
  Payload ID: 6646
  Gene Symbol: G0S2
  Gene Name: G0/G1 switch 2
  Uniprot ID: P27469
  ENST ID: ENST00000367029
  CDS Start-End: 163-474
gcggagtctccaactgggagagctgcagctgccgagaggaggagaacgctgaggtcggtcggaccaacggacgcgctgaccgctgccaactgcagctcgcgctgcctcctgctcgcgccgtgccactaaggtcattcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagagaggaatggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaaactttttatacca

SEQ ID NO: 136131 - DNA, 7105 bp, Homo sapiens
  Payload ID: 6647
  Gene Symbol: GSPT1
  Gene Name: G1 to S phase transition 1
  Uniprot ID: P15170
  ENST ID: ENST00000434724
  CDS Start-End: 201-2114
gccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaa

SEQ ID NO: 136132 - DNA, 1603 bp, Homo sapiens
  Payload ID: 6647
  Gene Symbol: GSPT1
  Gene Name: G1 to S phase transition 1
  Uniprot ID: P15170
  ENST ID: ENST00000420576
  CDS Start-End: 104-1603
ggaaacgggggcggccagaacagagaactaccgaggcgaagcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaa

SEQ ID NO: 136133 - DNA, 2509 bp, Homo sapiens
  Payload ID: 6647
  Gene Symbol: GSPT1
  Gene Name: G1 to S phase transition 1
  Uniprot ID: P15170
  ENST ID: ENST00000439887
  CDS Start-End: 159-2069
gagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcggcacctgtggaatcctctcaagaggaacagtcattgtgtgaaggttcaaattcagctgttagcatggaactttcagaacctattgaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaa

SEQ ID NO: 136134 - DNA, 1962 bp, Homo sapiens
  Payload ID: 6647
  Gene Symbol: GSPT1
  Gene Name: G1 to S phase transition 1
  Uniprot ID: P15170
  ENST ID: ENST00000563468
  CDS Start-End: 28-1527
tgtctaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatt

SEQ ID NO: 136135 - DNA, 466 bp, Homo sapiens
  Payload ID: 6647
  Gene Symbol: GSPT1
  Gene Name: G1 to S phase transition 1
  ENST ID: ENST00000562169
  CDS Start-End: 185-466
gcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttggcacctgtggaatcctctcaagaggaacagtcattgtgtgaaggttcaaattcagctgttagcatggaactttcagaacctattgaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggtt

SEQ ID NO: 136136 - DNA, 1864 bp, Homo sapiens
  Payload ID: 6647
  Gene Symbol: GSPT1
  Gene Name: G1 to S phase transition 1
  ENST ID: ENST00000565267
  CDS Start-End: 1-1427
gttcaaattcagctgttagcatggaactttcagaacctattgaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccaggccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttg

SEQ ID NO: 136137 - DNA, 790 bp, Homo sapiens
  Payload ID: 6647
  Gene Symbol: GSPT1
  Gene Name: G1 to S phase transition 1
  ENST ID: ENST00000568849
  CDS Start-End: 192-790
ggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatat

SEQ ID NO: 136138 - DNA, 2802 bp, Homo sapiens
  Payload ID: 6648
  Gene Symbol: GSPT2
  Gene Name: G1 to S phase transition 2
  Uniprot ID: Q8IYD1
  ENST ID: ENST00000340438
  CDS Start-End: 197-2083
gttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaa

SEQ ID NO: 136139 - DNA, 3112 bp, Homo sapiens
  Payload ID: 6649
  Gene Symbol: GTSE1
  Gene Name: G-2 and S-phase expressed 1
  Uniprot ID: Q9NYZ3
  ENST ID: ENST00000454366
  CDS Start-End: 213-2432
attcgctgcgctgaagcagtgcgcatgcgcactggacgcttcttaccagcgtcctgactacaatacccaggacgcacccagcccgccgcctctcggagcccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcatggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcata

SEQ ID NO: 136140 - DNA, 5804 bp, Homo sapiens
  Payload ID: 6650
  Gene Symbol: G2E3
  Gene Name: G2/M-phase specific E3 ubiquitin protein ligase
  Uniprot ID: Q7L622
  ENST ID: ENST00000206595
  CDS Start-End: 155-2275
gaccgctctttccgggtttgcgagcggaagtggacgaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggtaaactgcctatttaaactaagtaattttttgggatttaataagattaagattctgacgaaactgaaagatacaagattcctttactctccacatttgagagatcctataagcaagcagttagtgtctgacacccaggaacctatagaaatgagggaatctgtgttaaaactatgtatcctctaatgtaaaatagcttaccagaataaattatttaagccaaaa

SEQ ID NO: 136141 - DNA, 2334 bp, Homo sapiens
  Payload ID: 6650
  Gene Symbol: G2E3
  Gene Name: G2/M-phase specific E3 ubiquitin protein ligase
  ENST ID: ENST00000438909
  CDS Start-End: 217-2199
gaatttgaatcctgtgggccgttgaatgtggctgctcgcggtcggcgtgccccgacgtacagcgggccgggaaaagtggcactgaggctctggaacttctgcccagctctccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatat

SEQ ID NO: 136142 - DNA, 640 bp, Homo sapiens
  Payload ID: 6650
  Gene Symbol: G2E3
  Gene Name: G2/M-phase specific E3 ubiquitin protein ligase
  ENST ID: ENST00000548934
  CDS Start-End: 1-304
atgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgagataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttgga

SEQ ID NO: 136143 - DNA, 623 bp, Homo sapiens
  Payload ID: 6650
  Gene Symbol: G2E3
  Gene Name: G2/M-phase specific E3 ubiquitin protein ligase
  ENST ID: ENST00000547532
  CDS Start-End: 96-623
gcactaagcacatctacaatcaaggagaggggcaggctttaccttttgaaggaagaagtatgaaagtgtatcactgactgatcaagtagagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacag

SEQ ID NO: 136144 - DNA, 367 bp, Homo sapiens
  Payload ID: 6650
  Gene Symbol: G2E3
  Gene Name: G2/M-phase specific E3 ubiquitin protein ligase
  ENST ID: ENST00000552515
  CDS Start-End: 1-367
cgaagtccttgttgtaagaacgcttggtttcatagagactgtttacagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaatt

SEQ ID NO: 136145 - DNA, 565 bp, Homo sapiens
  Payload ID: 6650
  Gene Symbol: G2E3
  Gene Name: G2/M-phase specific E3 ubiquitin protein ligase
  ENST ID: ENST00000550944
  CDS Start-End: 204-565
gaatttgaatcctgtgggccgttgaatgtggctgctcgcggtcggcgtgccccgacgtacagcgggccgggaaaagtggcactgaggctctggaacttctgcccagctctccttgctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgc

SEQ ID NO: 136146 - DNA, 537 bp, Homo sapiens
  Payload ID: 6650
  Gene Symbol: G2E3
  Gene Name: G2/M-phase specific E3 ubiquitin protein ligase
  ENST ID: ENST00000554714
  CDS Start-End: 145-537
aatagccaatagttatcttttctgctcctctccctcctcccaccctcctgcgtcagctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaa

SEQ ID NO: 136147 - DNA, 3796 bp, Homo sapiens
  Payload ID: 6650
  Gene Symbol: G2E3
  Gene Name: G2/M-phase specific E3 ubiquitin protein ligase
  ENST ID: ENST00000553504
  CDS Start-End: 1448-3658
agagagagaagcaggaccgtggggtgggagagggtgtcaggaggccggacgtcgcagccggggcctcgcagtgcttttggggacgtctggtgctggggcccggcctggagactaagggaattcggggcactgggggcgtttgctggaccagcgctctcgacggttgcgcacgccagccagctctcagtgttgaggattcggaggccctgccggtcccccgcgagtaaaccttgtttatacgcatcctccgtggctttttttaaacccgtagtttattatttccaccaattcggctcgaatgctgaaattttaacagtagttaaatctcactgtgaaggcgttgccacgtttaaacaaatctcttttaatgaaagatggaaggttggggcgggtttagaatgaaaagatgctctacgtggctccgcgttcctcctgagagagatacccgggcaaccttgattaactctggactgcagggaagtgacagtctttgaaatgcctgagtgggatttaaactgaaattcgagtgtcctttgtatttaaaacccggatatttttctttcacggttgacatttttcatgtaccgcaaaaatccgagactcctatttaaaccggctgtggtaacagcggtggtgattaactagggtcttagtttgcaaacaatagggataaggtttagttccaccgccctgccttttcgcctccctcattcattggccaactgggttattatggagtctttttggaagtaatccactaatgctttgagcatctgtttctttgggttttattgttttgggcttttttttttttaatttttaatgatgaactatctgaaatatggaactctgtctaacccagtagtaaagtcatgccttctggaatggtttaaaagtgtgccataaatgtaaactataaatgggaactttaaatgtgtacaagttttacatctttattaaaaatcgtcagttttgtgtagcttaatacgaaaagatattttaagttccttttaaggttttaacaccaggatattgtaccatttaaatgtataaatatatttttaaaagtaggacttcataataatcagaataaaaacattccttcatccagtgctggctattccagcacccccattcttcctgctattgaacttttaagtgttagccaggaagaatagacttaaatactcggtgtttaggatagttaaaatatgagcatttttcatatagtgtctttgtaacagagacattggctatacttctctaagcctttctgctcatttcatatgtgctgtcaacaaatggtaatttttaaaaattgatcgctatatcctaatctctttatttttttctacctgaattattttcattggatttttgctctttcttaaatcagtgagtttcagaatttattgtgtatacactaccttgaaggatttgttcaacaatgctgattcctgcacttcagatctcagattctgaatcagtaggtctggaggatggcattgaacagtctgcatatttaactgaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaa

SEQ ID NO: 136148 - DNA, 411 bp, Homo sapiens
  Payload ID: 6650
  Gene Symbol: G2E3
  Gene Name: G2/M-phase specific E3 ubiquitin protein ligase
  ENST ID: ENST00000555429
  CDS Start-End: 175-411
aagcacatctacaatcaaggagaggggcaggctttaccttttgaaggaagaagtatgaaagtgtatcactgactgatcaagtagagctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactg

SEQ ID NO: 136149 - DNA, 5120 bp, Homo sapiens
  Payload ID: 6651
  Gene Symbol: GABPA
  Gene Name: GA binding protein transcription factor, alpha subunit 60kDa
  Uniprot ID: Q06546
  ENST ID: ENST00000354828
  CDS Start-End: 528-1892
gccccagccaggctgcgggcccgagacccccgggcctccctgccccccgcgccgccccgatttgccctcagagagggtatcgatcttatttctgggtctacggcaaactccaaggtctacaaacgtagaggtcagctgtgaccccgggccaggccgtgaaggtccccaggacacagagctgctctctcctcctagtaaaggtgagaggcagcccaggcctcgtgaaaaaacccagaactggagtcccaaaaggccacgctgatctagctaccctcccagtcaccttgcactcagtcccgagctgccaaagcctccgccgccaccacctccgctctacttccggccctggctccgcccccacacgcctacccgccatcgcaatgcattatgggccgccgtttcagtcggtcgacgctcaccggacaggaagcgtctcggagacagtctgcgaccggacgggtctaggtgagacagaagccaaacaggaggaggaagtggagggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagtagtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggtttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagta

SEQ ID NO: 136150 - DNA, 4814 bp, Homo sapiens
  Payload ID: 6651
  Gene Symbol: GABPA
  Gene Name: GA binding protein transcription factor, alpha subunit 60kDa
  Uniprot ID: Q06546
  ENST ID: ENST00000400075
  CDS Start-End: 222-1586
aggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagtagtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggtttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagta

SEQ ID NO: 136151 - DNA, 2726 bp, Homo sapiens
  Payload ID: 6652
  Gene Symbol: GABPB1
  Gene Name: GA binding protein transcription factor, beta subunit 1
  Uniprot ID: Q06547
  ENST ID: ENST00000220429
  CDS Start-End: 170-1357
ggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatcttttt

SEQ ID NO: 136152 - DNA, 1633 bp, Homo sapiens
  Payload ID: 6652
  Gene Symbol: GABPB1
  Gene Name: GA binding protein transcription factor, beta subunit 1
  Uniprot ID: Q06547
  ENST ID: ENST00000359031
  CDS Start-End: 449-1495
gctttctttgtgtggctgaagcgctagaaatggcatattttctttcccttcgttaaaaaatcagaccctctttcccctctctccccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcacagcatatttgtggaggaagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatg

SEQ ID NO: 136153 - DNA, 4816 bp, Homo sapiens
  Payload ID: 6652
  Gene Symbol: GABPB1
  Gene Name: GA binding protein transcription factor, beta subunit 1
  Uniprot ID: Q06547
  ENST ID: ENST00000380877
  CDS Start-End: 425-1576
gctttctttgtgtggctgaagcgctagaaatggcatattttctttcccttcgttaaaaaatcagaccctctttcccctctctccccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacatatgttcattgtagacttatgtttttatcacatcttattaacacattaaaaatgttatcctactgcatatttgagccaccatatgaaaatattttatactctccacaacatgactttaaaattcctgaggtaactcttgagaatttgttaactctttcactggaattaccagtatatttgttaatgtaataaaggggtctatggtctgtcagcctgatggttactattggaagcacttaaaaaagagtttagggcaaattgaagaactctgtaaggaagaggaaaaagatctttttcaattttccactaaatttgacatattttaagtgatccaaaaactagtttttaaaaatgccaggccatattttcaatagcatgaagtgactttttctgcagtcctgaaaagtcaatagagaatgttgtttctggttacttcggtacattaatttgtcatgttaggcagggtgctggtaccacagccaggtaccctgacatgtggtgctggagcagagaagggccagtgtcttcaccccagagggcaatcactgtagagttttgctttcagaccaggctggccctgaaaagactcaagacagtgttgggaacaagtttgtgaaagctaacttaatgtcgtctttgacttccagtctcctctcctgctggagactttacctggtgcaagaaataattttgattcctaataacaacagctggcatagatgggagaaaataattggtgcttaaaaggagtaagtctatgatagcatcaggtactcaggtatctgtggaggaagctcacctttttcagagtcattgttacataacataatttctcaatcatttacatctgatttactgttctgtaaaatcactacttagacaagaatttgtaattaaaacttaaaatgggtgtcttcttcccttcacttatttcatgctgttttcaggtgggctgtaaaagctttgcattctagtcattctcaatagtgctctgaacagaggatttaaagaactgacaaaaataaaagtatatgaaataaaagttttcagaaatccacataattgtttccactacatagtgatggatttgtagttagcagtcatctggttgccacatcactggttaattgtttccacatatgtgtgaacaaacacctggagcaacctttctcaaccagggttctgcaagacaagccatttagtgttatggtgtaatgaattattttctttcctgtgcacctagaatcgttcttgttacgtactatccagacactgagttcgttaggcatcttgactgcccaattactttattcagatttaacacttccctctgtatagtccctggacctctagaattataaattctagactgaatctgtgatgctttcagaaagcctcatctgagaagtagtatctgcagggactgtgcttctcaactaattttcatttattgttatttattttatttatatcttaattacttcacaaaaggacttgtgatgtcatttgttttcgttggcttttaggaattattttcttaacatcaatcttttgtgatatgaatggcagaagagttcttttactctgtcactggattgctctatttctttatggtggtggagggttgggaagacaattagagagaaaagaggataaatgggaaatctcatgtaatgaaagctacacagatggtccccaatttatgatgctttgatttatgattgtttgactttacaatgggtttatcagggtattaattgcattttacatttatgatatttttgacttaggatgggtttatcaggacataaccccattgcaagccagagagcatctgtacttgtttgtaataaaaagatctgcttac

SEQ ID NO: 136154 - DNA, 1401 bp, Homo sapiens
  Payload ID: 6652
  Gene Symbol: GABPB1
  Gene Name: GA binding protein transcription factor, beta subunit 1
  Uniprot ID: Q06547
  ENST ID: ENST00000396464
  CDS Start-End: 215-1261
gcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaa

SEQ ID NO: 136155 - DNA, 1392 bp, Homo sapiens
  Payload ID: 6652
  Gene Symbol: GABPB1
  Gene Name: GA binding protein transcription factor, beta subunit 1
  Uniprot ID: Q06547
  ENST ID: ENST00000429662
  CDS Start-End: 170-1252
ggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaa

SEQ ID NO: 136156 - DNA, 1450 bp, Homo sapiens
  Payload ID: 6652
  Gene Symbol: GABPB1
  Gene Name: GA binding protein transcription factor, beta subunit 1
  ENST ID: ENST00000543881
  CDS Start-End: 261-1220
attttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagtt

SEQ ID NO: 136157 - DNA, 1412 bp, Homo sapiens
  Payload ID: 6652
  Gene Symbol: GABPB1
  Gene Name: GA binding protein transcription factor, beta subunit 1
  ENST ID: ENST00000560825
  CDS Start-End: 243-1286
actcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcacagcatatttgtggaggaagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaat

SEQ ID NO: 136158 - DNA, 406 bp, Homo sapiens
  Payload ID: 6652
  Gene Symbol: GABPB1
  Gene Name: GA binding protein transcription factor, beta subunit 1
  ENST ID: ENST00000558335
  CDS Start-End: 138-406
aggaggggatgtgtatgagaacttctgagaagaaaggatcagaatgtatgcattctttttttgagcagaatattgatggttcatttttgtgacttacaagaaccagcagtttattggcttcattttgtaggaagcagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggtttt

SEQ ID NO: 136159 - DNA, 867 bp, Homo sapiens
  Payload ID: 6652
  Gene Symbol: GABPB1
  Gene Name: GA binding protein transcription factor, beta subunit 1
  ENST ID: ENST00000561010
  CDS Start-End: 1-610
aatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaaagagggtgtcttgctatgttgcccaggctggtcttggactcctggcctcaagtgatcctcccacctcagcctcctgaagagttgagattactggcataagtcaccatatccaggagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatac

SEQ ID NO: 136160 - DNA, 730 bp, Homo sapiens
  Payload ID: 6652
  Gene Symbol: GABPB1
  Gene Name: GA binding protein transcription factor, beta subunit 1
  ENST ID: ENST00000558970
  CDS Start-End: 463-730
atgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggattattccctcctttgctggacctctagtatccatggcacttgcccattaaatgctagcagagcatcctcaccttcagtctccaaaatgcctctataaacatacaaagggccctgaagggggcagtgctgctaccaatgagaaccactgatttccaagaatccatctacattaatctaccatatggcggccgggcgcggtggctcacgcctgtaatcccagcactatgggaggccgaggcgggcagatcacgagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttt

SEQ ID NO: 136161 - DNA, 1680 bp, Homo sapiens
  Payload ID: 6653
  Gene Symbol: GABPB2
  Gene Name: GA binding protein transcription factor, beta subunit 2
  ENST ID: ENST00000368916
  CDS Start-End: 33-1265
ctacctgaaaacttttgttcctatgcataaagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatga

SEQ ID NO: 136162 - DNA, 8964 bp, Homo sapiens
  Payload ID: 6653
  Gene Symbol: GABPB2
  Gene Name: GA binding protein transcription factor, beta subunit 2
  Uniprot ID: Q8TAK5
  ENST ID: ENST00000368918
  CDS Start-End: 332-1678
gcacttttccacctcagaagtgcctcagcagaaaggcgatgaacctcgggggtgcatcatctttctgttagaatgggagcatgagttttctgatcattttcccttcacagattcctccgccagaaatcttactcgcggcgccttcatttccgggtccgccattttgttgcctctgtttctccacgagggggggttaaaggcccccaaaacatgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcaggtgacccccatgcctcaacagtacagttttcaaattctaccacctcagtgctggctacccttgcagctcttgctgaggcatcagtccccctctccaactcacacagagccacagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatgatgcgtatctgttggaaaaaccaattggaagggaagttagacaagctttggggaagagaaaaggaatatagtccatttccaaaggagcaggaactcccaaccttaagttaatttcactgaagagaattttccctttttttttttttttttgagacacggtctgactctgtcacccaggctagagtacagtggtgcaatcttggctcactgcaacctccgcctccagggcgcagcctcctgagtagctgggaggacaggcatatgccaccacatcactgagaagaaatttttgattgtctgacagatacttatccattatgtgtctatagttcagatgcttgtgtaagaaactgaaataagctgcgtgtggtggctcacacctgtaatcccaacactttgggacgttgaaatgggagaattgcttgagtccaggagtttgagatgcgcctgggcaacatagaaacctgtgtctacaaaaaatttaaaaattagccaagtatggtgacaggcacctatggttccagctactcaggaggctgaggtgggaggatcgcttgtgccttggaggtcaaaactgcagtgagccatggttgcaccactgctctccaggcttgagtgacagagcaagactgtatctcaaaggaaaaaggaaactaggccaggcgtggtggctcacgcctgtaatcccaacactttgggaggccgaggcgggcggatcacgaggtcagatcaagaacatcctggctaacacggtgaaactccatctctactaaaaatacaaaaaattggccgggcgcagcggctcacgcctgtaatcccagcactttcggaggcagaggcaggcggatcacaaggtcaagagattaagatcatcctggccaacatggtgacaccccgtctctactaaaaatacaaaaattacccaggcatagtggcacacgcctgtagtcccagttacttgggaggctgaggcaggagaattgcttgaacctgggaggtggaggttgcagtgagccaagatcgtgccactgcactccagcctggcgacacagtgagactctgtctcaaaaaaacaaaacaaacaaacaaaaatacaaaaaattagccgggcgtggtggcacctgcctgtaatcccagctacttgggaggctgaggcaggagaatcgcttgaacccgggaggcggaggttgcagtgagctgagatcgcaccattacactccagcctgggcaacagagccagactctgtctcaaaaaaaaaaaaaaaggaaattgaaatagagtttttaaaaactgaactggaaagccgaggcgagcggatcacctgaggccaggagttccagaccagcctgaccaacatggagaaaccctgtctctactaaaaatacaaaattagggccagacccggcagctcatgcctgtaatcccagcactttgggaggctgaggtgggtggatcatgaggtcaggagttcaagaccagcctggccgagatggtgaaaccctactaaaaatacaaaaattcacctggcgaggtggcaggcacctggaatcccagctactcgggaggctgaggcggtagaatcacttgaacccaggtgacagaggttgcagtgatccaagatcatgccactgcactccagcctgggcgatagagtgagactctgtctcaaacaaacaaaacaaaacaaaattagctgggtgtggtggcacatgcctgtaatcccagctactcaggaggctgaggcaggagaatcgcttgaacccgggaggcggcagttgcaatgagccgagatggcaccattgcactccaacctgggcaacaagagtgaaactcaattaaaaaaaaaatagaaaagaaagaaaacttgtttatgtgggaggagtatatataaaaccaaaatccaggctgtgtttccacagtgctgggaagtggccagaaaaaggcttataggggctatgaaactctggtcttgacatataaactttgctctgactggatttcataaaattacagtgaggagggtagtctcttgtcagaaaaacttgtttccaaacatttatgtaatgtcaagctcagtctctcttttttttttttttttttttgagacggagtcttgctcttgttgcccaggctggagtgcaatggtgtgatctcaactcaccgcaacttccacctcccggtttcaagctattctcctgcctcagcctcccgagtagctgggattacaggcacgcgccaccacgcccggctaattttgtatattcagtagagacagggtttctctatgttggtcaggctggtctggaactcctggcctcaggtgatccacccgccttggcctcccaaaatgctgagattacaggcgtgagccaccccgcgcacagcctagactctaattttataaaactttgttgaattttctaagtgtcatttaggacatattgtgcttttctgtggagcttatatcttatcctcttatgtgcaacaaaaagggggtcggaggtaaatgctgatgatgttgtttagttttatttccttttgatctggcatgagtaaattgctctgtttccttaagcttgggtctgttacagagctttgtgccttatagggtgctcagtgtgtgttgacaaagggaataagaactgtcagtgccataaagaaccaaagattctggctactttgtcttcttcctttctctcccactatgcctacacttcctctgcccagacacttttggaaagtgtttaactgctgggttttctttttctttttctttttttttttgagacggagtttcactcttgttgcccaggctggagtgcaatggcgtgatcttggctcaccgcaacctctacctcctgggttcaagtgattctcctgcctcagcctcccgagtagctgggactacaggcatgcgccacaatgcctggctaattttgtatttttagtagagatggggtttctccatgttagtcgggctggtcttgaactcctgacctcaggtgatccacctgtctcgacctcccaaagtgctgggattataggcgtgagccactgcgcctgaccacctacctgctgggttttctttgtatgtcagcatggagtttttcccaaagaaagggaatatggatggagagagagaggttatgaacaggttatgttacagaggttattgcctttgaaactgggccctcatcattctagacttgcttgctttgttataaattagaagaaaccagagggagatgtgccaagtaaacattcgaatgactgtttagaatatggttttcttaattagcagtcatggggaaaacatgcatttttaatttggaaaaaacctgacagttaacatggttctgtttaccttgattagtgaagtaatttgctgcagtgttacagaggagcagaatcacttgggtctcaaaatagactgaaaatttaactccccaaaccaaatttaacaaacagaattggttattagagatttataggcaaaaatatcagtttggaaattaaccttggctactggccaccttagctaggttttctccacagatctgttttctccacagatctgagtacttaacacttcccagatgattggagaatattctgggctgttggggatgacaggaaaatgtgagggggagtagcctaggtaagggtgatgatgaaattgttctatctgctgtcaaataatcttttcctgtttgcaatgtttttattttttctgagtccctttgggaaccaggtgctaacaagaagctgttatgtgtgggatttcggagccttactttaacgatagaggaaccaagtatcattttagatatcttttatttatgttctcggtgcatatgttgactttaatccctcttcccccacacctcgcccattaaggggaaggaggttaactctgcagatgatattcaggcccaaccagctcactctctggggtggctactgactaaaggcagagaatgtccatccaacatgcccttctgactatacagtcaccacttttttgggggaattctttagcagatcttattgttctttctgcagaagctatcattcctacctccccaacccccaaaatctctaatacaggccaagtcattttttatgatgggtctctgagatagggcagtttgttagaggagaggctagggtagagagggagagaatggaggtatctgaaaataagtaagaaaaaggcattgatttttatttactcggaacggtcctcttggcatcccagataagggaaataggatttgatctccaattgtattgccatggagagaatggcaggtgaggatgctttgaagtagttagaaattaaatattgaatacattaatggcaataccatttcatgactttgcatatctttctggattagtcatggaagttggggaaatattgcttagatcttctgggttagaggattccaactgtttattggcaaggttggattattaagaatcaaatagcagacaaaaatggctgggcacggtggctcacgcctgtaatcccagcactttgagaggctgaggtgggtagatcacttgaggtgaggagttcgagaccagcctggccgacatggcaaaaccctgtctctaccaaaatacaaaaattagttgggcatgatggcatacgcctgtagtcccagctactctggaggctgaaacaggagaattgcttgaacccaaaaggtggagtttacagtgagctgagattgtgccactgcactccagcctgggcaatagagcgagactctgtctcaaaaaaaaaaaaaaaagaaggaaagaaagaaaaaacagacaaatggatcagaattggtgcttgagcaagagaaacttcgagcttaggatggttgtctactttaaaataaagctgctggccgggcacagtggctcacgcctgtaacctcagcactttgggaggccaaggcaggtggatcacgaggtcaggagattgagaccatcctggctaacacagtgaaaccctggccctactaaaaatacaaaaaattagccgggcgtggtggtgggtgcctgtagtcccagctactcgggaggctgaggcaggagaatgacgtgaacccaggaggcagagcttgcagtgagctgagatcgccccactgcaacagatcgcctgggcaacagaatgagactcggtctcaaaaaataaaataaaataaaataaaataaaataagtaaagctgctggccagacatggtggctcacgcctgtaatcccagcactttgggaggccgagatgggaggatcacttgaggccaggccagcgtggtgaaactcagtctctactaaaaatacaaaaattagccgggggtggtggcgcatcatcatactggtgagaaaaaaaaaaaaaaaaaagaggccgggcgcggtggctcacaaaaaaaaaaaaaagaaagaaaaaggaaaaaaagaaatatcagtttgagaaatgatttttttttcttttttcttttctttttttttttttaaacagagtctctctctgtcacccaggctggagcgcagtggcatgatcttggctcattgcaacctctgtctcccgggttcaagcgattcttctgcctcagcctctgaagtagctgggattacaggcacgcgctaatttttgtatttttagtacagacgggatttcaccatattggccaggctggtctcgaactcctgacctcgtgatccaccctccttggcctcccaaagtgctgggattacaggtgtgagccaccacgcccagcctctttttttttttttttttctcaccagtatgatgatgaccattttaagaaagcttgtgtggctctctcctatcattacagacctccagagctggaaaatttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctgtccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccga

SEQ ID NO: 136163 - DNA, 1634 bp, Homo sapiens
  Payload ID: 6654
  Gene Symbol: GABARAP
  Gene Name: GABA(A) receptor-associated protein
  Uniprot ID: O95166
  ENST ID: ENST00000302386
  CDS Start-End: 441-794
gttgttaacgaaaggaacttggagaaccaagtctcgtatgatgattaccatcttttactcctcttcagccccagcttccttgaggggacggttggggaataggtttagagtaattttcgatgagcaaaagccaaccgtctttgctacgtcgcctgcgtagcccacaaattgattccaaagcgattacgctaatggcgtgagggggccggtcagttggtggtgctacgctagcagcgttagcgccgctgaggtagtggcgtatcttagcggggggggcagtccccgatagtcgggggcggggttggtgaatagggaagtggcgcaaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctcatgtaaaaaaaaatttttttttactgtgggttcctgtggagaaagttccgaagtacctgctttaggtgaacatccacatttgctagaacattctaactaagatattttcatgtgtgcaagctagtaaaacggctgttctca

SEQ ID NO: 136164 - DNA, 476 bp, Homo sapiens
  Payload ID: 6654
  Gene Symbol: GABARAP
  Gene Name: GABA(A) receptor-associated protein
  ENST ID: ENST00000573928
  CDS Start-End: 118-414
aaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggtatggtgactgggaagtggtggaggctttggagaggaatcttggaagagcgtgaggggaagaaagtgttg

SEQ ID NO: 136165 - DNA, 837 bp, Homo sapiens
  Payload ID: 6654
  Gene Symbol: GABARAP
  Gene Name: GABA(A) receptor-associated protein
  ENST ID: ENST00000571253
  CDS Start-End: 754-837
gaccgggtgccggtgaggacagtagccagggccgagggcgcgggacgcttacgctgacgccacagcctggccttggatcgggacaggcagcgcagggatcaggctgctggctgtggtggggttggcagcgagcctgaaactgctgtccttgggacccaggatgaaaggagtggggtagtggtggatgtggggttgagagggatgtggacaggagagagaaaccttagcatttgaggccttagagagtttgacagcctgagcttcaaatggtcatccccccagctagctaaggttgcgagattgaatcactagtcgacccaaacaagtcacctccgtctgattaagatagttgtttatggtgacgccctattgggggatggatcctggatatttaaatgagctccagtcagtgaggtcaggatctctgggactcagtgctgcaccgcgtgtacaaagacaaagagatgaatctggggtagatttaggtgctaggaatattgtttcttgagttcttgacaggtgcagcttcggggctgcattccttctgtctcctaattttcatctctttatcaggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtga

SEQ ID NO: 136166 - DNA, 583 bp, Homo sapiens
  Payload ID: 6654
  Gene Symbol: GABARAP
  Gene Name: GABA(A) receptor-associated protein
  ENST ID: ENST00000570856
  CDS Start-End: 29-139
agccctgtccagcccggttcccgggaggatgaagttcgtgtacaaagaagagcatccgttcgagaagcgccgctctgagggcgagaagatccgaaagaaatacccggaccgggtgccgttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgt

SEQ ID NO: 136167 - DNA, 762 bp, Homo sapiens
  Payload ID: 6654
  Gene Symbol: GABARAP
  Gene Name: GABA(A) receptor-associated protein
  ENST ID: ENST00000577035
  CDS Start-End: 233-316
agtgctgcaccgcgtgtacaaagacaaagagatgaatctggggtagatttaggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgc

SEQ ID NO: 136168 - DNA, 568 bp, Homo sapiens
  Payload ID: 6654
  Gene Symbol: GABARAP
  Gene Name: GABA(A) receptor-associated protein
  ENST ID: ENST00000571129
  CDS Start-End: 259-342
gatcaggctgctggctgtggtggggttggcagcgagcctgaaactgctgtccttgggacccaggatgaaaggagtggggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgccttt

SEQ ID NO: 136169 - DNA, 1957 bp, Homo sapiens
  Payload ID: 6655
  Gene Symbol: GABARAPL1
  Gene Name: GABA(A) receptor-associated protein like 1
  Uniprot ID: Q9H0R8
  ENST ID: ENST00000266458
  CDS Start-End: 326-679
ctgggcgcctggcgcatggggggcggggcggggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 136170 - DNA, 855 bp, Homo sapiens
  Payload ID: 6655
  Gene Symbol: GABARAPL1
  Gene Name: GABA(A) receptor-associated protein like 1
  Uniprot ID: Q9H0R8
  ENST ID: ENST00000421801
  CDS Start-End: 295-735
ggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttgtctgactatagtcttgtctgactatagtgttttaatgctggactgtttattga

SEQ ID NO: 136171 - DNA, 582 bp, Homo sapiens
  Payload ID: 6655
  Gene Symbol: GABARAPL1
  Gene Name: GABA(A) receptor-associated protein like 1
  ENST ID: ENST00000545290
  CDS Start-End: 552-582
gcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgagg

SEQ ID NO: 136172 - DNA, 1423 bp, Homo sapiens
  Payload ID: 6655
  Gene Symbol: GABARAPL1
  Gene Name: GABA(A) receptor-associated protein like 1
  ENST ID: ENST00000542722
  CDS Start-End: 483-614
ttggccaaagggatcccaggaggcctggccctcttttctcctgaggctggatcccaaccagcaggaaaaggctggattttcgccttttgtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggcttt

SEQ ID NO: 136173 - DNA, 531 bp, Homo sapiens
  Payload ID: 6655
  Gene Symbol: GABARAPL1
  Gene Name: GABA(A) receptor-associated protein like 1
  ENST ID: ENST00000544284
  CDS Start-End: 350-433
acagcccgacgcgccacccagctgtttttgtgctcccagctctagcgaaaagccgccggtatttctccatctggctctcctctacctccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaagg

SEQ ID NO: 136174 - DNA, 559 bp, Homo sapiens
  Payload ID: 6655
  Gene Symbol: GABARAPL1
  Gene Name: GABA(A) receptor-associated protein like 1
  ENST ID: ENST00000545047
  CDS Start-End: 254-364
gtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtg

SEQ ID NO: 136175 - DNA, 760 bp, Homo sapiens
  Payload ID: 6655
  Gene Symbol: GABARAPL1
  Gene Name: GABA(A) receptor-associated protein like 1
  ENST ID: ENST00000539408
  CDS Start-End: 482-613
ggggcagcggaacgcgcagagggcacggtgcaagcacgggacagctctgcattggccaaagggatcccaggaggcctggccctcttttctcctgaggctggatcccaaccagcaggaaaaggctggattttcgccttttgtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggac

SEQ ID NO: 136176 - DNA, 2321 bp, Homo sapiens
  Payload ID: 6655
  Gene Symbol: GABARAPL1
  Gene Name: GABA(A) receptor-associated protein like 1
  ENST ID: ENST00000540424
  CDS Start-End: 234-365
agcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcagatggagtattcaaagcacaaagaaatgcagtaacttcctaaaggtttcacattgctgatctgtggttgagctggaattccaaccctgtctgaaggactgtggagctctcgggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttacctt

SEQ ID NO: 136177 - DNA, 572 bp, Homo sapiens
  Payload ID: 6655
  Gene Symbol: GABARAPL1
  Gene Name: GABA(A) receptor-associated protein like 1
  ENST ID: ENST00000537201
  CDS Start-End: 209-340
atctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggaccagcagctgttggattttggaaatggaggagcggagattttaaaattgtgctctttatcttcagatggagtattcaaagcacaaa

SEQ ID NO: 136178 - DNA, 553 bp, Homo sapiens
  Payload ID: 6655
  Gene Symbol: GABARAPL1
  Gene Name: GABA(A) receptor-associated protein like 1
  ENST ID: ENST00000545859
  CDS Start-End: 343-553
gtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctga

SEQ ID NO: 136179 - DNA, 571 bp, Homo sapiens
  Payload ID: 6655
  Gene Symbol: GABARAPL1
  Gene Name: GABA(A) receptor-associated protein like 1
  Uniprot ID: Q9H0R8
  ENST ID: ENST00000545887
  CDS Start-End: 101-454
ctctcctctacctccaggcaggctcacccgagatccccgccccgaaccccccctgcacactcggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacat

SEQ ID NO: 136180 - DNA, 1700 bp, Homo sapiens
  Payload ID: 6655
  Gene Symbol: GABARAPL1
  Gene Name: GABA(A) receptor-associated protein like 1
  ENST ID: ENST00000539170
  CDS Start-End: 359-442
gacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaat

SEQ ID NO: 136181 - DNA, 792 bp, Homo sapiens
  Payload ID: 6655
  Gene Symbol: GABARAPL1
  Gene Name: GABA(A) receptor-associated protein like 1
  ENST ID: ENST00000535576
  CDS Start-End: 709-792
gacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatga

SEQ ID NO: 136182 - DNA, 3214 bp, Homo sapiens
  Payload ID: 6655
  Gene Symbol: GABARAPL1
  Gene Name: GABA(A) receptor-associated protein like 1
  ENST ID: ENST00000541960
  CDS Start-End: 25-336
atctcggaagccctgcggtgcatcatgaagttccagtacaaggaggaccatccctttgagtatcggaaaaaggaaggagaaaagatccggaagaaatatccggacagggtccccgtgagtgtagaggagcggaggggatgggaggggaagggcccgcgggggcgggggcgggtagtcgagatggcttccctggggcgcccaggcggctctggagaagggaggttccgagaattacttaatcctgaacgcccttcagtgccagagccaatggacgtccagactgtagagcttttaaaaccccgtatgcctgggccccgaaccccacttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaacccttttcctttaaaaagaaaaaaaagtcattagggctcttcattccccaggaattacaaaaaggttttcagcttatagaggggtgagctaatcccttactcgggaaaggatcctttacaaattactttcctggtttctggaccttggatacctgaaaattttgcccagttctggtgataccaatcttttgagcaatgatatttaaaaaatacaatcaagttttattgatagtttaccctagcggtattataagtactcagtctgtaatcattgacttacttccttacacgattacccgttctacagatggagtattcaaagcacaaagaaatgcagtaacttcctaaaggtttcacattgctgatctgtggttgagctggaattccaaccctgtctgaaggactgtggagctctcgggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaa

SEQ ID NO: 136183 - DNA, 653 bp, Homo sapiens
  Payload ID: 6655
  Gene Symbol: GABARAPL1
  Gene Name: GABA(A) receptor-associated protein like 1
  Uniprot ID: Q9H0R8
  ENST ID: ENST00000543602
  CDS Start-End: 146-586
gtgctcccagctctagcgaaaagccgccggtatttctccatctggctctcctctacctccaggcaggctcacccgagatccccgccccgaaccccccctgcacactcggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttg

SEQ ID NO: 136184 - DNA, 584 bp, Homo sapiens
  Payload ID: 6655
  Gene Symbol: GABARAPL1
  Gene Name: GABA(A) receptor-associated protein like 1
  ENST ID: ENST00000541453
  CDS Start-End: 254-364
gtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgt

SEQ ID NO: 136185 - DNA, 2294 bp, Homo sapiens
  Payload ID: 6655
  Gene Symbol: GABARAPL1
  Gene Name: GABA(A) receptor-associated protein like 1
  ENST ID: ENST00000546017
  CDS Start-End: 940-1023
acttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttacctt

SEQ ID NO: 136186 - DNA, 379 bp, Homo sapiens
  Payload ID: 6655
  Gene Symbol: GABARAPL1
  Gene Name: GABA(A) receptor-associated protein like 1
  ENST ID: ENST00000629504
  CDS Start-End: 248-379
gtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttga

SEQ ID NO: 136187 - DNA, 1002 bp, Homo sapiens
  Payload ID: 6656
  Gene Symbol: GABARAPL2
  Gene Name: GABA(A) receptor-associated protein like 2
  Uniprot ID: P60520
  ENST ID: ENST00000037243
  CDS Start-End: 137-490
cgacagccggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggca

SEQ ID NO: 136188 - DNA, 646 bp, Homo sapiens
  Payload ID: 6656
  Gene Symbol: GABARAPL2
  Gene Name: GABA(A) receptor-associated protein like 2
  ENST ID: ENST00000568455
  CDS Start-End: 312-485
ggccgagtggagcggggcggatgccctgctgcgggctggagtcgcccatgccctggtgcctcgggcagcggccccctgaccccatgtcaccctccgcgggccttgctgggagctagtaggggacaggaccgcggccccggggacgccggaaccagggcctgggttaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactag

SEQ ID NO: 136189 - DNA, 571 bp, Homo sapiens
  Payload ID: 6656
  Gene Symbol: GABARAPL2
  Gene Name: GABA(A) receptor-associated protein like 2
  ENST ID: ENST00000565057
  CDS Start-End: 113-379
gtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccaggtgagaggtgtttactagatgggccctctggtattagacatctggttggctgcttacggaactccaaaactttggaagtctgaaaactcttaggggtcctgactagaaatctggattttatgctccctgacatcaggggctccaggaaaataatggctgcaatacataagagtgcattttggattcagaaaataga

SEQ ID NO: 136190 - DNA, 791 bp, Homo sapiens
  Payload ID: 6656
  Gene Symbol: GABARAPL2
  Gene Name: GABA(A) receptor-associated protein like 2
  ENST ID: ENST00000563744
  CDS Start-End: 99-227
gtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccgcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggca

SEQ ID NO: 136191 - DNA, 1445 bp, Homo sapiens
  Payload ID: 6657
  Gene Symbol: GALK1
  Gene Name: galactokinase 1
  Uniprot ID: P51570
  ENST ID: ENST00000225614
  CDS Start-End: 101-1279
gctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacgacggagtctggctctgtcaccctgtctggagtgcggtaacacgatctcggttcactgcaacctgcgccttctgggttcaagtgattctcctgcctcagcctcctgactagctgggactacaggcatgagccaccatgcctgtct

SEQ ID NO: 136192 - DNA, 717 bp, Homo sapiens
  Payload ID: 6657
  Gene Symbol: GALK1
  Gene Name: galactokinase 1
  ENST ID: ENST00000592997
  CDS Start-End: 1-555
gggatgccctgtggcatcatggaccagttcatctcacttatgggacagaaaggccacgcgctgctcattgactgcagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtacctgcctcctctagaggtgggtgtatgcttgggtgtcagagaa

SEQ ID NO: 136193 - DNA, 1866 bp, Homo sapiens
  Payload ID: 6657
  Gene Symbol: GALK1
  Gene Name: galactokinase 1
  Uniprot ID: P51570
  ENST ID: ENST00000588479
  CDS Start-End: 576-1754
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaa

SEQ ID NO: 136194 - DNA, 1180 bp, Homo sapiens
  Payload ID: 6657
  Gene Symbol: GALK1
  Gene Name: galactokinase 1
  ENST ID: ENST00000586244
  CDS Start-End: 57-419
atcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagagccctaaaccaggaggacaattagaagtgtcccagcaacctcagagggtgggaaaatggagggcagtgggtcccttggcccagcagctgcccccctccctggcttcagtgcagtggtggtcagctcagtgcccctggggggtggcctgtccagctcagcatccttggaagtggccacgtacaccttcctccagcagctctgtccaggtaccagctaggccccagccctgacccagccctccttccctgaggtctccaggtggtcccagcttctactatgccttatggagggggtggcagggactctccctggagtgtcattgaagccactgctgcttccaccagccctagcctccccacctcaccctgtactgcagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggttgggctcgctcccctcgtcccctcccgccctgcactcagcagctcctgggtgggagtgtgcccactgcctggcgcagcaagcacacgcttggcctcgtcatctcccccattgtaactccaccccaggtccttggagaccagcctggtgccactctcggaccccaagctggccgtgctcatcaccaactctaatgtccgccactccctggcctccagcgagtaccctgtgcggcggcgccaatgtgaagaagtgg

SEQ ID NO: 136195 - DNA, 667 bp, Homo sapiens
  Payload ID: 6657
  Gene Symbol: GALK1
  Gene Name: galactokinase 1
  ENST ID: ENST00000587707
  CDS Start-End: 1-276
gatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagccctagcctccccacctcaccctgtactgcagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgc

SEQ ID NO: 136196 - DNA, 5299 bp, Homo sapiens
  Payload ID: 6658
  Gene Symbol: GALK2
  Gene Name: galactokinase 2
  Uniprot ID: Q01415
  ENST ID: ENST00000327171
  CDS Start-End: 233-1576
gtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaacttagataaaaaacactttaagactcttctattcacattgaaataaagaattatctagatgataattcagataattcagtttgttcatagaattactttcttatcactctttttctactactttttctcaaatacctctctaatccaagaggcacttccaagaaattccacacattccttatatcccttttttgcttgtctagcaaagcttgtttgtatatatgcaccccattgtaaagcaggtatgcaggtatgtgggtgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgtaatgatttggaccaaaaagtattttgctgaaatactcaggtaattgagatagcaatggttttatggcatgaattatccaaaaaaatatcagaattacttattattctgtgatttcattagctcattaatgtttaactcacagattgggcatcaccatctagaatttcagtttaagggaggcctgcgcaaagctagttttatttcttaaaggataacagtcatacatagaatactaggaaagccaatattctatttaaaaataaacttctgatgcattttcattcttagcagaaaggtaaatgcttgagaaagcttgagtcaaatttgttaaaagaattttgagttctataaatccaaaaatctgaaacctgaatttatttaaatttataatcctttattttttaataccgtgccattttccacaaaggatttgtggttggtatataattctttaaagatacctggatcagtgtaaaaaaaaaaaaaaaaaggcacctgtcattgttttgctgttccatttacaattttcaccaggtgatttcttcttcacaaaaggtgagtaaaaatttccaatgtgcactcttctttgggggacacacatggtcattctaagcgagggatctattctatatttgttttgatttctctcgataaaaagaactatgtttcagtcttactatcactgtgtggtatctagatattatgagagatgctaaacttacctggaagggatagggccggggccattagaaaaaagatcatgcagtaaatggactttgagcatggccctaaaagatgagtagagtttaaaagctgtggagtgcacactgcagatgagcaaagcctatgggtataggcaaacatggtgtgtgtaggaggctcagtgagagtgaaggctttgctttggtatgtagtgaagaataagattgactacactggctggagctagcttttgaagagtcaaatccaggcagcatttagatcaggggttatagcccagcagcccatgggccacatctggtctgcagatgtatatagtttggcccacagaatgactaaaaacttgggctccaaatcaggagattgtacaagcagtatcagatattctggattactcagaatctggattactgagtggtggaatatctgatactacttgtccaacatttctacagggcatcaatgaactagggctgagatagtagctgccttgttagatgaggcatggctatccagtgcgctacagtttccacaactgcttgtataatagtttccctgacactcaaatcatttaccacttaccagctgaggtcacttgccctttatcaggacacttgcactgttgttttcctattctaattaggtatttctctgtgcccatgtccctatcaatagtagggaagatagaccaaaaaaaaaaaaaaagagagaaagaatgaatatttttgtgtgtggatgtaaaaaatagtccttagctgggagtggtggcatgtgcctgctgtcccagctactcaggaggctgaggcaggaggatcacttgagctgaggacttcaaagctacagtgagccatgactgcagcactgcactccagcctgggagacaggtgacagagtgagaccctgtttcaacaacaacaacaaaaatgaatagtcctgtttgcttattatactgtcctgtttgtatattatacaacacccaggtgtttcactctttctatcacttttctgccccatgtaggaatttgatttgatccatttttgacattatactagcagccaatgggattgctctagatttttgaatggaagccttgacatgctgaaagtaaaaggctctcctctatccctgacctccaattgtccagcattcagacatattgtacactagtctctacatgttcttgtctgttgggagagaagaagcccttcagacttaacaagaatgcccataagtaaagagaagcaaaagagaagatgacaaggaaaatcagaaagatggaacaggctcctttcttttctttctttctcatacttgagtcctgtttagaaccttatcatattctgccttgataattgagggcagggaccattcatctaacacagctgttggtacccaatatgattttgttgaattattaatgaaaaacttacaattttaaacatcagtgattattagtttgtaattctaactgcatttggagcttttcagttacataaactgttcctggtcagaagctggaaatggggaatgtgaacatgagttgtcactaaatatgtaaaacagattttcttacatgtgcatgtagatgattaagtaacaagaatgtatcctctcctgccactgtaatttgggtgtgccaccatacattgcttatgaaatattgtccagtctatataaaagaagctagagagagaattctcaattattttcagaaagaaaacctaccagtttatgtaggaacttctcaaagtcctgtttcacttcatgaggtttcttggtagcctttgcttggagtctaatcatggaataaagaaaatcagtaaccaaa

SEQ ID NO: 136197 - DNA, 1834 bp, Homo sapiens
  Payload ID: 6658
  Gene Symbol: GALK2
  Gene Name: galactokinase 2
  ENST ID: ENST00000396509
  CDS Start-End: 175-1479
agggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactg

SEQ ID NO: 136198 - DNA, 1950 bp, Homo sapiens
  Payload ID: 6658
  Gene Symbol: GALK2
  Gene Name: galactokinase 2
  ENST ID: ENST00000544523
  CDS Start-End: 244-1548
agacacttgaaactacaggagaaagaaggatctagcgaaatatggctacagagagccctgctacgcgtcgggtccaggtggcagaacatcctagatggagtctcgctctgtcacctgtgctggaggctagagtgcaagtggcacgatcttggctcactgcaacctccgcctcctgggttgaagtgattctcctgcctccgcctccggagtagctgggattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctgg

SEQ ID NO: 136199 - DNA, 722 bp, Homo sapiens
  Payload ID: 6658
  Gene Symbol: GALK2
  Gene Name: galactokinase 2
  ENST ID: ENST00000560138
  CDS Start-End: 96-722
gacacttgaaactacaggagaaagaaggatctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaaggtgcaggctaaactagggattagtctagaagaaatgctgttg

SEQ ID NO: 136200 - DNA, 620 bp, Homo sapiens
  Payload ID: 6658
  Gene Symbol: GALK2
  Gene Name: galactokinase 2
  ENST ID: ENST00000560528
  CDS Start-End: 1-332
gtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaacttagataaaaaacactttaagactcttctattcacattgaaataaagaattatctagatgataattcaga

SEQ ID NO: 136201 - DNA, 641 bp, Homo sapiens
  Payload ID: 6658
  Gene Symbol: GALK2
  Gene Name: galactokinase 2
  ENST ID: ENST00000558956
  CDS Start-End: 162-395
tttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccgtcttccgggctgcagggctccctcaggcagaggctatgacctgcagataggccacaccattcttggactggtcctgtagagcagggttccccaatccctgttactgcttcatggcctgttcagaagtgggccacacagcaggagggacttcagtactagtgctaataacatccagattgataaaaccaagcctttgtggcacaactatttcttatgtggacttaaaggaattcaggaacactttggtcttagtaacctgactggaatgaactgcctggtagatgg

SEQ ID NO: 136202 - DNA, 2043 bp, Homo sapiens
  Payload ID: 6658
  Gene Symbol: GALK2
  Gene Name: galactokinase 2
  Uniprot ID: Q01415
  ENST ID: ENST00000560031
  CDS Start-End: 308-1684
tagtcagcttcgcacgtgctctgcgcaggggctcctgcgaggccctagtccctccctgggagctaagagcaggacggaggctgtacctgactgctgcttggagggaaccctggctgagtccagggaggaggagccagaggaggggccgattggaagcagccacctcagcgaagctgcaggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgatac

SEQ ID NO: 136203 - DNA, 1768 bp, Homo sapiens
  Payload ID: 6658
  Gene Symbol: GALK2
  Gene Name: galactokinase 2
  ENST ID: ENST00000559454
  CDS Start-End: 120-1424
cggggagcaagtggaacccttgggattctataaggacacgtggctgggcttgcaaaaaagatcacgccgcaaacacattctaccttgactactacgaagggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgtta

SEQ ID NO: 136204 - DNA, 991 bp, Homo sapiens
  Payload ID: 6658
  Gene Symbol: GALK2
  Gene Name: galactokinase 2
  ENST ID: ENST00000559883
  CDS Start-End: 342-467
cttctttccgccttccagtccctcttagaggagctgtttcctgccggaactaattatctcgacttgtagctgattcgctacgactccaaaagagactgcaccaccccccgtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagtctagagtgcagtggcatgatctcggctcactacaacctccgcctcctgggttcaagcgattctcctgcctcagcctccctagaagctggaattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcattt

SEQ ID NO: 136205 - DNA, 550 bp, Homo sapiens
  Payload ID: 6658
  Gene Symbol: GALK2
  Gene Name: galactokinase 2
  ENST ID: ENST00000561074
  CDS Start-End: 204-341
aactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagatggagtctcgctctgtcacctgtgctggaggctagagtgcaagtggcacgatcttggctcactgcaacctccgcctcctgggttgaagtgattctcctgcctccgcctccggagtagctgggattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaata

SEQ ID NO: 136206 - DNA, 805 bp, Homo sapiens
  Payload ID: 6658
  Gene Symbol: GALK2
  Gene Name: galactokinase 2
  ENST ID: ENST00000558399
  CDS Start-End: 1-472
gctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggtgctttggaaataccagccagctcatgcatcttaagataatataaaatcaatggactctgacctccaaaattgaagagaacacgattaaactctggaccagtactactatagtgcgactgtaagaggaagaaaataatcaagacaacgattacttttgtgtttctaaaaaactgtgaataaaatataacttcatatttagcataaagttaccatttgatatattaaaataaaggaaattctacaaagcatcttcttaattagaggaatttaccaaagtatgagtctataagtacatgcagtaaggctcttctactcttttgagttatcatcagacttgcatataggcaatagacattattcagtcttaagaacagaaa

SEQ ID NO: 136207 - DNA, 655 bp, Homo sapiens
  Payload ID: 6658
  Gene Symbol: GALK2
  Gene Name: galactokinase 2
  ENST ID: ENST00000559580
  CDS Start-End: 1-489
tgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtgctttggaaataccagccagctcatgcatcttaagataatataaaatcaatggactctgacctccaaaattgaagagaacacgattaaactctggaccagtactactatagtgcgactgtaagaggaagaaaataatcaagacaacgattacttttgtgtttctaaaaaactgtgaataaaatataacttcatatttagcataaa

SEQ ID NO: 136208 - DNA, 794 bp, Homo sapiens
  Payload ID: 6658
  Gene Symbol: GALK2
  Gene Name: galactokinase 2
  ENST ID: ENST00000559963
  CDS Start-End: 239-388
ccccccgtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagatggagtcttgctttgttgcccagtctagagtgcagtggcatgatctcggctcactacaacctccgcctcctgggttcaagcgattctcctgcctcagcctccctagaagctggaattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggctt

SEQ ID NO: 136209 - DNA, 895 bp, Homo sapiens
  Payload ID: 6658
  Gene Symbol: GALK2
  Gene Name: galactokinase 2
  ENST ID: ENST00000559423
  CDS Start-End: 67-300
tctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccgtcttccgggctgcagggctccctcaggcagaggctatgacctgcagataggccacaccattcttggactggtcctgtagagcagggttccccaatccctgttactgcttcatggcctgttcagaagtgggccacacagcaggagggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaag

SEQ ID NO: 136210 - DNA, 861 bp, Homo sapiens
  Payload ID: 6658
  Gene Symbol: GALK2
  Gene Name: galactokinase 2
  ENST ID: ENST00000559208
  CDS Start-End: 100-405
cccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccgtcttccgggctgcagggctccctcaggcagaggctatgacctgcagataggccacaccattcttggactggtcctgtagagcagggttccccaatccctgttactgcttcatggcctgttcagaagtgggccacacagcaggagggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgataga

SEQ ID NO: 136211 - DNA, 813 bp, Homo sapiens
  Payload ID: 6658
  Gene Symbol: GALK2
  Gene Name: galactokinase 2
  ENST ID: ENST00000558775
  CDS Start-End: 223-372
aagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagatggagtcttgctttgttgcccagtctagagtgcagtggcatgatctcggctcactacaacctccgcctcctgggttcaagcgattctcctgcctcagcctccctagaagctggaattacaggttactgaagctaaaggagatgtttaactccaagtttggatctattcccaagttttatgttcgagcaccaggaagagtcaacataatagctttctcttttttctaggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgct

SEQ ID NO: 136212 - DNA, 2053 bp, Homo sapiens
  Payload ID: 6658
  Gene Symbol: GALK2
  Gene Name: galactokinase 2
  ENST ID: ENST00000560119
  CDS Start-End: 119-319
gattgctctgggagctttgcttagacacttgaaactacaggagaaagaaggatctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccgaaataaaaagggtcagttggaggtagtttagtcactaaggccactgcaacttcctctcttaactcttagcagctggagatgttttgctgtagacacacagtttgaacataaaagggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgacggagtcgtgctctatcgcccaggctggagtgcaacggcgtgatctcagctcactgcaacctctgcctcccaggttcaagcaattctcccacttcagtctctcaaatagctgggattacatgcacccaccatcatcatgcccagtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgt

SEQ ID NO: 136213 - DNA, 784 bp, Homo sapiens
  Payload ID: 6658
  Gene Symbol: GALK2
  Gene Name: galactokinase 2
  ENST ID: ENST00000560654
  CDS Start-End: 390-784
tccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagagacaagatcttgctctgtcacccaggctggagtgcagtggcaccatcatagcttactgcagcctcgaactccttggtttaagtgaccttcccatctcagcctcctcagtggctaggacttcaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggctt

SEQ ID NO: 136214 - DNA, 567 bp, Homo sapiens
  Payload ID: 6658
  Gene Symbol: GALK2
  Gene Name: galactokinase 2
  ENST ID: ENST00000558145
  CDS Start-End: 327-567
gattgctctgggagctttgcttagacacttgaaactacaggagaaagaaggatctagcgaaatatggctacagagagccctgctacgcgtcgggtccaggtggcagaacatcctagcctcatcagcatctgttagtttttgacacattttggtaacagccattctgactagtgtaagatggagtctcgctctgtcacctgtgctggaggctagagtgcaagtggcacgatcttggctcactgcaacctccgcctcctgggttgaagtgattctcctgcctccgcctccggagtagctgggattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagc

SEQ ID NO: 136215 - DNA, 2363 bp, Homo sapiens
  Payload ID: 6659
  Gene Symbol: GALNS
  Gene Name: galactosamine (N-acetyl)-6-sulfatase
  Uniprot ID: P34059
  ENST ID: ENST00000268695
  CDS Start-End: 90-1658
aggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 136216 - DNA, 1953 bp, Homo sapiens
  Payload ID: 6659
  Gene Symbol: GALNS
  Gene Name: galactosamine (N-acetyl)-6-sulfatase
  ENST ID: ENST00000567525
  CDS Start-End: 1-210
agcgccgcggggatgggggcctcgggcgccccgcagccccccaacatcctgctcctgctcatggacgaccgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtgatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagctt

SEQ ID NO: 136217 - DNA, 703 bp, Homo sapiens
  Payload ID: 6659
  Gene Symbol: GALNS
  Gene Name: galactosamine (N-acetyl)-6-sulfatase
  ENST ID: ENST00000568311
  CDS Start-End: 94-444
gtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacgaatcactcccgccacctcgggccgccgggtccccccgctgggctccagtcttacctgacggctgtctctgtcctctggagaatgctgagcgaagtgactgctttccagagcacgctctccagcgcccaggggtccgtgtcctgacagcagtagccgggcctttctctgcactgagtggcatctccctcctaaagatactttgcttcagaatttcatcctttcacttttgaagttcctctgggccagtgtagatactttgtttcagaatttcttcttttcattgtgtaactccttctgggccagcatagcttcgctggatgagctgggctctgcaggtgaagcctccctgttaagtttctgcttttcctgactttctcagaggacagaggggtgaggcggggcagctcatgaataattttttatgttgaagacttgtcgaaataatattttggttatgttgggttaaataaaatataaagttagtctgta

SEQ ID NO: 136218 - DNA, 609 bp, Homo sapiens
  Payload ID: 6659
  Gene Symbol: GALNS
  Gene Name: galactosamine (N-acetyl)-6-sulfatase
  ENST ID: ENST00000562831
  CDS Start-End: 98-609
cgtgcggggagggggaggcccctcggggagtggccgcggggtccaggcgtggggtctcggcggtcaccgatcaccacacgcgctgccactgtgctgcatgaccgggacagcgtcctccctggcagcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaa

SEQ ID NO: 136219 - DNA, 723 bp, Homo sapiens
  Payload ID: 6659
  Gene Symbol: GALNS
  Gene Name: galactosamine (N-acetyl)-6-sulfatase
  ENST ID: ENST00000569433
  CDS Start-End: 55-291
ggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacgaatcactcccgccacctcgggccgccgggtccccccgctgggctccagtcttacctgacggctgtctctgtcctctggagaatgctgagcgaaggtcaggtgtccctaaggtctgaagaactgaaaggctggaatgtctcctggtgggcaagtgcggggtcaggggtcacagccagcctggaggcctccttccctaactccttgtgggagccacctggagactcaggaatgagcctgcctggggcatgggtcaccgtgcaggaccccagacacacctgggttgaaaccctactgtctccaagcttgggggtcacttccattcttgaacctcagctgccacacctggggggttacacctgtcccgccgtgctcacgttgtgtgtgaggactgggacgacaccgagtaccagacagttttgggccgtcggtgtcgctcagcccctgtgtgctggctccgaccagcagagaccctgacaggtgccttcagacccacctgtgctgaccagtgggggccacgggccacacccaagggctgggcagtcgtggct

SEQ ID NO: 136220 - DNA, 1804 bp, Homo sapiens
  Payload ID: 6659
  Gene Symbol: GALNS
  Gene Name: galactosamine (N-acetyl)-6-sulfatase
  ENST ID: ENST00000568613
  CDS Start-End: 1-156
agcgccgcggggatgggggcctcgggcgccccgcagccccccaacatcctgctcctgctcatggacgacatgcacgtgtttagaggccagctcctgcgagcatgcagatgctggtgtcaggctgggaggaggcagacggacacattccccacctgaagaccaagcagaagtggaggcgaaagacagcgtgggctgaccgtggagcggccccatcgtgcacgcacgcaggcgatgctgagatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagca

SEQ ID NO: 136221 - DNA, 2484 bp, Homo sapiens
  Payload ID: 6660
  Gene Symbol: GALM
  Gene Name: galactose mutarotase (aldose 1-epimerase)
  Uniprot ID: Q96C23
  ENST ID: ENST00000272252
  CDS Start-End: 253-1281
gacgagccaaggaaaaaaagtacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaacttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacctgtagtcccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttcagaa

SEQ ID NO: 136222 - DNA, 1023 bp, Homo sapiens
  Payload ID: 6660
  Gene Symbol: GALM
  Gene Name: galactose mutarotase (aldose 1-epimerase)
  ENST ID: ENST00000410063
  CDS Start-End: 46-630
ggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaac

SEQ ID NO: 136223 - DNA, 724 bp, Homo sapiens
  Payload ID: 6660
  Gene Symbol: GALM
  Gene Name: galactose mutarotase (aldose 1-epimerase)
  ENST ID: ENST00000434934
  CDS Start-End: 1-657
cgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagtttcctttccagcatgggatcatttggagacagagaaacctagaggacaatagcagaatcctttgattcacatgtgagtgctgctacttccttattatagtagaataaaccaggccaatcttccaataactaa

SEQ ID NO: 136224 - DNA, 834 bp, Homo sapiens
  Payload ID: 6660
  Gene Symbol: GALM
  Gene Name: galactose mutarotase (aldose 1-epimerase)
  ENST ID: ENST00000444351
  CDS Start-End: 1-585
ctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggtggcaccaacagaaggtttctgcaaggctgagagctccttttacccatggaccaggagcaaagtttgcaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttaca

SEQ ID NO: 136225 - DNA, 1768 bp, Homo sapiens
  Payload ID: 6661
  Gene Symbol: GALT
  Gene Name: galactose-1-phosphate uridylyltransferase
  Uniprot ID: P07902
  ENST ID: ENST00000378842
  CDS Start-End: 43-1182
gcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaaggg

SEQ ID NO: 136226 - DNA, 1280 bp, Homo sapiens
  Payload ID: 6661
  Gene Symbol: GALT
  Gene Name: galactose-1-phosphate uridylyltransferase
  Uniprot ID: P07902
  ENST ID: ENST00000450095
  CDS Start-End: 319-1131
acgtgctggcggctggccaatcatcgggggcggcgcggggaggggtggtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaata

SEQ ID NO: 136227 - DNA, 838 bp, Homo sapiens
  Payload ID: 6661
  Gene Symbol: GALT
  Gene Name: galactose-1-phosphate uridylyltransferase
  ENST ID: ENST00000473506
  CDS Start-End: 68-430
gtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatg

SEQ ID NO: 136228 - DNA, 890 bp, Homo sapiens
  Payload ID: 6661
  Gene Symbol: GALT
  Gene Name: galactose-1-phosphate uridylyltransferase
  ENST ID: ENST00000554085
  CDS Start-End: 29-301
attttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagcctatccttgtcggtaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagct

SEQ ID NO: 136229 - DNA, 578 bp, Homo sapiens
  Payload ID: 6661
  Gene Symbol: GALT
  Gene Name: galactose-1-phosphate uridylyltransferase
  ENST ID: ENST00000554897
  CDS Start-End: 31-285
agattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagtaaggtcatgtgcttccacccctggtcggatgtaacgctgccactcatgtcggtccctgagatccgggctgttgttgatgcatgggcctcagtcacagaggagctgggtgcccagtacccttgggtgcagggtgtggtcaggagggagttgacttggtgtcttttggctaacagagctccgtatccctatctgatagatctttgaaaacaaaggtgccatgatgggctgttctaacccccacccccactgccaggtatgggccagcagtttcctgccagatattgcccagcgtgag

SEQ ID NO: 136230 - DNA, 1164 bp, Homo sapiens
  Payload ID: 6661
  Gene Symbol: GALT
  Gene Name: galactose-1-phosphate uridylyltransferase
  ENST ID: ENST00000554550
  CDS Start-End: 70-324
gtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctg

SEQ ID NO: 136231 - DNA, 807 bp, Homo sapiens
  Payload ID: 6661
  Gene Symbol: GALT
  Gene Name: galactose-1-phosphate uridylyltransferase
  ENST ID: ENST00000556244
  CDS Start-End: 1-178
tgagtgggtgctggtgtcagctcaccgcatgaagcggccctggcagggtcaagtggagccccagcttctgaagacagtgccccgccatgaccctctcaaccctctgtgtcctggggccatccgagccaacggagagggtgggccttccctactcccttgtagcctgtccagtctttgaagcccaccaggtaactggtggtatggggcagtgagtgcttctagcctatccttgtcggtaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatg

SEQ ID NO: 136232 - DNA, 1782 bp, Homo sapiens
  Payload ID: 6662
  Gene Symbol: GAL3ST1
  Gene Name: galactose-3-O-sulfotransferase 1
  Uniprot ID: Q99999
  ENST ID: ENST00000338911
  CDS Start-End: 195-1466
ctggggctgtctctttccaggtggttgtcagtctatctctccagtgcctctctgtccctgtctggaccctgctggggggccacagagcaggcaaaggcagggctcaactgccaggcctgggcagccttgggggctccctggggccagcttcctgacacttgccctactctgtgctgcccctgcaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtt

SEQ ID NO: 136233 - DNA, 1712 bp, Homo sapiens
  Payload ID: 6662
  Gene Symbol: GAL3ST1
  Gene Name: galactose-3-O-sulfotransferase 1
  Uniprot ID: Q99999
  ENST ID: ENST00000402369
  CDS Start-End: 123-1394
aggcctggtggagcggggggcccggccgggtgcgccccgccgcccagtgagcgcccgggcggcgcggcccgggccgagccagccacgctgaggcggaggaggacggggacaaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 136234 - DNA, 1791 bp, Homo sapiens
  Payload ID: 6662
  Gene Symbol: GAL3ST1
  Gene Name: galactose-3-O-sulfotransferase 1
  Uniprot ID: Q99999
  ENST ID: ENST00000401975
  CDS Start-End: 204-1475
ggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtt

SEQ ID NO: 136235 - DNA, 1819 bp, Homo sapiens
  Payload ID: 6662
  Gene Symbol: GAL3ST1
  Gene Name: galactose-3-O-sulfotransferase 1
  Uniprot ID: Q99999
  ENST ID: ENST00000406361
  CDS Start-End: 242-1513
gcatggaccaggcctggtggagcggggggcccggccgggtgcgccccgccgcccagtgagcgcccgggcggcgcggcccgggccgagccagccacgctgaggcggaggaggacggggacaagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttg

SEQ ID NO: 136236 - DNA, 1908 bp, Homo sapiens
  Payload ID: 6662
  Gene Symbol: GAL3ST1
  Gene Name: galactose-3-O-sulfotransferase 1
  Uniprot ID: Q99999
  ENST ID: ENST00000402321
  CDS Start-End: 319-1590
gaatctttctgtgcccttggatgaaagagctgcttgcttgttggggtccaaagagaggtgaggactggccagagctgtccagtggaggcagaaggcctgggcaacacctgcagggtactggggtgtgccacctgctatccccaggaagcaaactcatgaatattcacaccactggagtgggagggagccagccagcttgctgctgggtgtcattggagcattcctgtctcccagtgatcgcagaggcagcctgggagttggacgtggctcaggcagtgggtagaaaggggcagccagccacagcccgaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 136237 - DNA, 1635 bp, Homo sapiens
  Payload ID: 6662
  Gene Symbol: GAL3ST1
  Gene Name: galactose-3-O-sulfotransferase 1
  Uniprot ID: Q99999
  ENST ID: ENST00000406955
  CDS Start-End: 46-1317
actattgcagcctccctgattccagaaggtaccttggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 136238 - DNA, 553 bp, Homo sapiens
  Payload ID: 6662
  Gene Symbol: GAL3ST1
  Gene Name: galactose-3-O-sulfotransferase 1
  ENST ID: ENST00000428682
  CDS Start-End: 246-553
agtgatcgcagaggcagcctgggagttggacgtggctcaggcagtgggtagaaaggggcagccagccacagcccgaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccg

SEQ ID NO: 136239 - DNA, 575 bp, Homo sapiens
  Payload ID: 6662
  Gene Symbol: GAL3ST1
  Gene Name: galactose-3-O-sulfotransferase 1
  ENST ID: ENST00000448604
  CDS Start-End: 361-575
gatgcacaaatggaattctgggcccggctgcaggctcctgaagggctccttgcttcactttgactggccttagagcctgttctgggctctctgcaggcgtctgcggttgctgtgtccttggcccaaggatacctggaatctttctgtgcccttggatgaaagagctgcttgcttgttggggtccaaagagaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtg

SEQ ID NO: 136240 - DNA, 894 bp, Homo sapiens
  Payload ID: 6662
  Gene Symbol: GAL3ST1
  Gene Name: galactose-3-O-sulfotransferase 1
  ENST ID: ENST00000441967
  CDS Start-End: 58-894
cctagagagaaggcgactctggtctgccttgtggcagtttaagctctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaac

SEQ ID NO: 136241 - DNA, 582 bp, Homo sapiens
  Payload ID: 6662
  Gene Symbol: GAL3ST1
  Gene Name: galactose-3-O-sulfotransferase 1
  ENST ID: ENST00000416358
  CDS Start-End: 72-582
acaaatggaattctgggcccggctgcaggctcctgaagggctccttgcttcactttgactgggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcg

SEQ ID NO: 136242 - DNA, 656 bp, Homo sapiens
  Payload ID: 6662
  Gene Symbol: GAL3ST1
  Gene Name: galactose-3-O-sulfotransferase 1
  ENST ID: ENST00000423299
  CDS Start-End: 210-656
attcctgtctcccagtgatcgcagaggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtg

SEQ ID NO: 136243 - DNA, 572 bp, Homo sapiens
  Payload ID: 6662
  Gene Symbol: GAL3ST1
  Gene Name: galactose-3-O-sulfotransferase 1
  ENST ID: ENST00000411821
  CDS Start-End: 318-572
gatgcacaaatggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccagccttagagcctgttctgggctctctgcaggcgtctgcggttgctgtgtccttggcccaaggatacctggaatctttctgtgcccttggatgaaagagctgcttgcttgttggggtccaaagagaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaag

SEQ ID NO: 136244 - DNA, 851 bp, Homo sapiens
  Payload ID: 6662
  Gene Symbol: GAL3ST1
  Gene Name: galactose-3-O-sulfotransferase 1
  ENST ID: ENST00000431313
  CDS Start-End: 56-851
cccgggccgagccagccacgctgaggcggaggaggacggggacaaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccaccaggaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacc

SEQ ID NO: 136245 - DNA, 533 bp, Homo sapiens
  Payload ID: 6662
  Gene Symbol: GAL3ST1
  Gene Name: galactose-3-O-sulfotransferase 1
  ENST ID: ENST00000427899
  CDS Start-End: 43-533
attgcagcctccctgattccagaaggtaccttggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccaccaggaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgct

SEQ ID NO: 136246 - DNA, 639 bp, Homo sapiens
  Payload ID: 6662
  Gene Symbol: GAL3ST1
  Gene Name: galactose-3-O-sulfotransferase 1
  ENST ID: ENST00000453479
  CDS Start-End: 339-639
tcagccagcttaaaaattaaaaggagtggaaagtttggggccctggttctctacccggttcattttaatttttaaattttaaccttctccctgccccattccccaacctctctttgagttgcttcacccaccgtctctgcaaccctggggctgtctctttccaggtggttgtcagtctatctctccagtgcctctctgtccctgtctggaccctgctggggggccacagagcaggcaaaggcagggctcaactgccaggcctgggcagccttgggggctccctggggccagcttcctgacacttgccctactctgtgctgcccctgcaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccaga

SEQ ID NO: 136247 - DNA, 567 bp, Homo sapiens
  Payload ID: 6662
  Gene Symbol: GAL3ST1
  Gene Name: galactose-3-O-sulfotransferase 1
  ENST ID: ENST00000445645
  CDS Start-End: 341-567
ggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcg

SEQ ID NO: 136248 - DNA, 639 bp, Homo sapiens
  Payload ID: 6662
  Gene Symbol: GAL3ST1
  Gene Name: galactose-3-O-sulfotransferase 1
  ENST ID: ENST00000423371
  CDS Start-End: 302-639
atgcacaaatggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccaccaggaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccg

SEQ ID NO: 136249 - DNA, 755 bp, Homo sapiens
  Payload ID: 6662
  Gene Symbol: GAL3ST1
  Gene Name: galactose-3-O-sulfotransferase 1
  ENST ID: ENST00000437282
  CDS Start-End: 158-755
gattccagaaggtaccttgggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacc

SEQ ID NO: 136250 - DNA, 882 bp, Homo sapiens
  Payload ID: 6662
  Gene Symbol: GAL3ST1
  Gene Name: galactose-3-O-sulfotransferase 1
  ENST ID: ENST00000452827
  CDS Start-End: 156-882
actattgcagcctccctgattccagaaggtaccttgggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtgg

SEQ ID NO: 136251 - DNA, 584 bp, Homo sapiens
  Payload ID: 6662
  Gene Symbol: GAL3ST1
  Gene Name: galactose-3-O-sulfotransferase 1
  ENST ID: ENST00000443136
  CDS Start-End: 154-584
gaagggctccttgcttcactttgactgggtgaggaatatggatgagcccttttaggggctccacacgactccaaacagggcagagcaggatggaacacaggtgcccatgggggtcatcaggctggggactgctggaatctccaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgctt

SEQ ID NO: 136252 - DNA, 567 bp, Homo sapiens
  Payload ID: 6662
  Gene Symbol: GAL3ST1
  Gene Name: galactose-3-O-sulfotransferase 1
  ENST ID: ENST00000447224
  CDS Start-End: 281-567
gattccagaaggtaccttgaaaagttctccagagaatggctaggggcgcctccagctttctcattttacagatgaaaaactgagactccatgagggttcttggcttgtctgaaatcacagtgctggattgaaacacaggcttgagggtcccagagcctgagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgtt

SEQ ID NO: 136253 - DNA, 563 bp, Homo sapiens
  Payload ID: 6662
  Gene Symbol: GAL3ST1
  Gene Name: galactose-3-O-sulfotransferase 1
  ENST ID: ENST00000426220
  CDS Start-End: 268-563
tcctgaagggctccttgcttcactttgactgggtgaggaatatggatgagcccttttaggggctccacacgactccaaacagggcagagcaggatggaacacaggtgcccatgggggtcatcaggctggggactgctggaatctccagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcgg

SEQ ID NO: 136254 - DNA, 1370 bp, Homo sapiens
  Payload ID: 6663
  Gene Symbol: GAL3ST2
  Gene Name: galactose-3-O-sulfotransferase 2
  Uniprot ID: Q9H3Q3
  ENST ID: ENST00000192314
  CDS Start-End: 132-1328
tcacctgccccacagccgcaccctgcctgtgcctgcaccctggggagcccagagccggcaggggccgaggcggtgggacctcgggggagctcaagcctcgactgtcccctcgctggaggccagaggccaagatgatgtccatgctgggcggcttgcagagatacttccgggtcatcctcctcctcctcctggccctgactctgctcctgctggccggattcctgcactcggacttagagctggacacacccctgtttgggggccaggctgaggggccgccggtcaccaacatcatgttcctgaagacgcacaagacggccagcagcacggtgctcaacatcctctaccgcttcgccgagacccacaacctgtccgtggcgctgcccgccggctcacgcgtccacctgggctacccctggctcttcctggcgcgctacgtggaaggcgtggggtcgcagcagcgcttcaacatcatgtgcaaccacctgaggttcaacctgcctcaggtgcagaaagtcatgcccaacgacaccttctacttctccatcctgaggaaccccgtgttccagctggagtcctccttcatctactacaaaacctacgcccccgccttccggggcgccccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggagcggcgcttccggctggtgctcatcgccgagcacctggacgagtccctggtgctgctgcggcgccggctgcgctgggcgctggacgacgtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtagaggggccgggccggggacgaggcctcctgcggacaccagctc

SEQ ID NO: 136255 - DNA, 1210 bp, Homo sapiens
  Payload ID: 6663
  Gene Symbol: GAL3ST2
  Gene Name: galactose-3-O-sulfotransferase 2
  ENST ID: ENST00000610560
  CDS Start-End: 1-1168
atacttccgggtcatcctcctcctcctcctggccctgactctgctcctgctggccggattcctgcactcggacttagagctggacacacccctgtttgggggccaggctgaggggccgccggtcaccaacatcatgttcctgaagacgcacaagacggccagcagcacggtgctcaacatcctctaccgcttcgccgagacccacaacctgtccgtggcgctgcccgccggctcacgcgtccacctgggctacccctggctcttcctggcgcgctacgtggaaggcgtggggtcgcagcagcgcttcaacatcatgtgcaaccacctgaggttcaacctgcctcaggtgcagaaagtcatgcccaacgacaccttctacttctccatcctgaggaaccccgtgttccagctggagtcctccttcatctactacaaaacctacgcccccgccttccggggcgccccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggagcggcgcttccggctggtgctcatcgccgagcacctggacgagtccctggtgctgctgcggcgccggctgcgctgggcgctggacgacgtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtagaggggccgggccggggacgaggcctcctgcggacaccagctc

SEQ ID NO: 136256 - DNA, 1170 bp, Homo sapiens
  Payload ID: 6663
  Gene Symbol: GAL3ST2
  Gene Name: galactose-3-O-sulfotransferase 2
  ENST ID: ENST00000632847
  CDS Start-End: 1-1170
agatacttccgggtcatcctcctcctcctcctggccctgactctgctcctgctggccggattcctgcactcggacttagagctggacacacccctgtttgggggccaggctgaggggccgccggtcaccaacatcatgttcctgaagacgcacaagacggccagcagcacggtgctcaacatcctctaccgcttcgccgagacccacaacctgtccgtggcgctgcccgccggctcacgcgtccacctgggctacccctggctcttcctggcgcgctacgtggaaggcgtggggtcgcagcagcgcttcaacatcatgtgcaaccacctgaggttcaacctgcctcaggtgcagaaagtcatgcccaacgacaccttctacttctccatcctgaggaaccccgtgttccagctggagtcctccttcatctactacaaaacctacgcccccgccttccggggcgccccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggagcggcgcttccggctggtgctcatcgccgagcacctggacgagtccctggtgctgctgcggcgccggctgcgctgggcgctggacgacgtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtag

SEQ ID NO: 136257 - DNA, 2133 bp, Homo sapiens
  Payload ID: 6664
  Gene Symbol: GAL3ST3
  Gene Name: galactose-3-O-sulfotransferase 3
  Uniprot ID: Q96A11
  ENST ID: ENST00000312006
  CDS Start-End: 283-1578
ctagcggacgctgccacctgatcccatccaggcgctgagaggcaagccaccggcactcggcgcgcagggccccgggcaccctcggaccccgtgcggatttcgagacaagggtccagagatagcggcggccgcccccaacccgggccagaggcagagcccaggcgtgcggtgcttctcgggaacactggccctgctaccagagccgcaggatcccccatgagtgcctgtgaagggagtcctggatagtgaggccctggctggtccaggggtgggtactccgccatgccacccatcctccagcgcctgcagcaggccaccaagatgatgagccgccggaaaatcctgctgctggtgctagggtgcagcaccgtaagccttctcatccaccagggggcgcagctcagctggtaccccaagctgttccccttgagctgccctcctctgcggaactcgccgccgcgccccaagcacatgactgtggccttcctgaagactcacaagacggcaggcacgacggtgcagaacatcctgtttcgctttgccgagcgccacaacctgacggtggccctgccgcacccgagctgcgagcaccagttctgctacccccgcaacttctcggcgcacttcgtgcacccggccacgcggccgccgcacgtgctggccagccacctgcgcttcgaccgtgcggagctggagcgcctcatgccgcccagcaccgtctatgtcaccatcctgcgcgagccggccgccatgttcgagtcgctcttcagctactacaaccagtactgcccggccttccggcgcgtacccaacgcctcgctcgaggccttcctgcgcgcgcccgaggcatactaccgcgctggcgagcacttcgccatgttcgcacacaacacgctggcctacgacctgggcggcgacaatgagcgcagcccgcgcgacgacgccgcctacctggcgggcctcatccgccaggtggaggaggttttctcgctcgtcatgatcgccgagtacttcgacgagtcgctagtgctgctgcggcgcctactggcctgggacctggacgacgtgctctacgccaagctcaacgcgcgcgccgccagctcgcgcctggccgccatccccgcggcgctggcgcgggcggcgcgcacctggaacgccctggacgccggcctctacgaccacttcaacgccaccttctggcgccacgtggcgcgcgcgggccgcgcgtgcgtggagcgcgaggcgcgcgagctgcgcgaggcccgccagcgcctactgcggcgctgcttcggggacgagccactgctgcggcctgccgcgcagatccgcaccaagcagctgcagccgtggcagcccagccgcaaggtggacattatgggctatgacctgcccggcggcggcgccggcccggccaccgaggcctgcctcaagctggccatgcccgaggtccagtactcgaactacctgttgcgcaagcagaagcgccggggcggtgcgcgggctcggcccgagcccgtcctggacaatcccccgcctcggcccatccgagtgctgcctcgcggccctcaaggtccctgagctccgcaggcctccaggagtatgggtcctgccctgccctcccaggagtccagccaggggctgcctccatgtcctgcccccatgagagccctttcttttcaaggggcttgagtccctcgctgaactttggggtacgcctccctatctgagcccccgctcccgatcgtgggctgaaccttgccttcgggcacggcgctgataggctggatccagcgctgggccaccctctccttcccagctggttggtgattttgacaagaggcctgagggctgtccagaactgctcaccctgcctttttctgggggctgagcccccacaacctgtcttttccaagtggataagcccaggccccatggagagaggctcagccctagggaaaggctgctcttgctctccctcccagggcttgaggctccctatacttttctgtcttccaggttctaccctccccacagacctaagctgctcccagtctcccagaaccaagagttcttgggttgggatttttgtttggttggtttttcttttttttaataaaacatctttaaaatgtg

SEQ ID NO: 136258 - DNA, 1599 bp, Homo sapiens
  Payload ID: 6664
  Gene Symbol: GAL3ST3
  Gene Name: galactose-3-O-sulfotransferase 3
  Uniprot ID: Q96A11
  ENST ID: ENST00000527878
  CDS Start-End: 161-1456
atcccatctcctctgcccactgcaaacccgtctgccttcttctgccaggcttctcgggaacactggccctgctaccagagccgcaggatcccccatgagtgcctgtgaagggagtcctggatagtgaggccctggctggtccaggggtgggtactccgccatgccacccatcctccagcgcctgcagcaggccaccaagatgatgagccgccggaaaatcctgctgctggtgctagggtgcagcaccgtaagccttctcatccaccagggggcgcagctcagctggtaccccaagctgttccccttgagctgccctcctctgcggaactcgccgccgcgccccaagcacatgactgtggccttcctgaagactcacaagacggcaggcacgacggtgcagaacatcctgtttcgctttgccgagcgccacaacctgacggtggccctgccgcacccgagctgcgagcaccagttctgctacccccgcaacttctcggcgcacttcgtgcacccggccacgcggccgccgcacgtgctggccagccacctgcgcttcgaccgtgcggagctggagcgcctcatgccgcccagcaccgtctatgtcaccatcctgcgcgagccggccgccatgttcgagtcgctcttcagctactacaaccagtactgcccggccttccggcgcgtacccaacgcctcgctcgaggccttcctgcgcgcgcccgaggcatactaccgcgctggcgagcacttcgccatgttcgcacacaacacgctggcctacgacctgggcggcgacaatgagcgcagcccgcgcgacgacgccgcctacctggcgggcctcatccgccaggtggaggaggttttctcgctcgtcatgatcgccgagtacttcgacgagtcgctagtgctgctgcggcgcctactggcctgggacctggacgacgtgctctacgccaagctcaacgcgcgcgccgccagctcgcgcctggccgccatccccgcggcgctggcgcgggcggcgcgcacctggaacgccctggacgccggcctctacgaccacttcaacgccaccttctggcgccacgtggcgcgcgcgggccgcgcgtgcgtggagcgcgaggcgcgcgagctgcgcgaggcccgccagcgcctactgcggcgctgcttcggggacgagccactgctgcggcctgccgcgcagatccgcaccaagcagctgcagccgtggcagcccagccgcaaggtggacattatgggctatgacctgcccggcggcggcgccggcccggccaccgaggcctgcctcaagctggccatgcccgaggtccagtactcgaactacctgttgcgcaagcagaagcgccggggcggtgcgcgggctcggcccgagcccgtcctggacaatcccccgcctcggcccatccgagtgctgcctcgcggccctcaaggtccctgagctccgcaggcctccaggagtatgggtcctgccctgccctcccaggagtccagccaggggctgcctccatgtcctgcccccatgagagccctttcttttcaaggggcttgagtccctcgctgaactttggggtacgcctccct

SEQ ID NO: 136259 - DNA, 2537 bp, Homo sapiens
  Payload ID: 6665
  Gene Symbol: GAL3ST4
  Gene Name: galactose-3-O-sulfotransferase 4
  Uniprot ID: Q96RP7
  ENST ID: ENST00000360039
  CDS Start-End: 394-1854
gaggggaagatgcagcgagggagagacctagaaccgcgatcaaagctgcagcagctgctggggctggcggcacaaagggaggagggaggagcctgggcgctgagaaagttcttggggaaagttgagctgagccaagagtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaactt

SEQ ID NO: 136260 - DNA, 1695 bp, Homo sapiens
  Payload ID: 6665
  Gene Symbol: GAL3ST4
  Gene Name: galactose-3-O-sulfotransferase 4
  ENST ID: ENST00000423751
  CDS Start-End: 257-919
gtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcc

SEQ ID NO: 136261 - DNA, 2334 bp, Homo sapiens
  Payload ID: 6665
  Gene Symbol: GAL3ST4
  Gene Name: galactose-3-O-sulfotransferase 4
  Uniprot ID: Q96RP7
  ENST ID: ENST00000413800
  CDS Start-End: 190-1650
gacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttc

SEQ ID NO: 136262 - DNA, 1404 bp, Homo sapiens
  Payload ID: 6665
  Gene Symbol: GAL3ST4
  Gene Name: galactose-3-O-sulfotransferase 4
  ENST ID: ENST00000411994
  CDS Start-End: 136-798
gtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgt

SEQ ID NO: 136263 - DNA, 735 bp, Homo sapiens
  Payload ID: 6665
  Gene Symbol: GAL3ST4
  Gene Name: galactose-3-O-sulfotransferase 4
  ENST ID: ENST00000482469
  CDS Start-End: 338-735
gtctctctgtccctctgtctctctctctctgtttctctgtgtgtgtgtgtgtgtgtgtgtgtgtctctctctctttctgtctccctctccagccccaccctttcagtctcctccgggtgcactgataaggttggaaagtggaatggtggacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcct

SEQ ID NO: 136264 - DNA, 579 bp, Homo sapiens
  Payload ID: 6665
  Gene Symbol: GAL3ST4
  Gene Name: galactose-3-O-sulfotransferase 4
  ENST ID: ENST00000498000
  CDS Start-End: 224-579
gattaggaagctcgggcttcagaaggaactctgcaacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttccccca

SEQ ID NO: 136265 - DNA, 548 bp, Homo sapiens
  Payload ID: 6665
  Gene Symbol: GAL3ST4
  Gene Name: galactose-3-O-sulfotransferase 4
  ENST ID: ENST00000460995
  CDS Start-End: 217-548
aagctcgggcttcagaaggaactctgcaacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctctt

SEQ ID NO: 136266 - DNA, 1318 bp, Homo sapiens
  Payload ID: 6666
  Gene Symbol: GLA
  Gene Name: galactosidase, alpha
  Uniprot ID: P06280
  ENST ID: ENST00000218516
  CDS Start-End: 23-1312
atgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtt

SEQ ID NO: 136267 - DNA, 1358 bp, Homo sapiens
  Payload ID: 6666
  Gene Symbol: GLA
  Gene Name: galactosidase, alpha
  ENST ID: ENST00000493905
  CDS Start-End: 6-674
tgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagagctccacactatttggaagtatttgttgacttgttaccatgtctccccactagagtcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtt

SEQ ID NO: 136268 - DNA, 2018 bp, Homo sapiens
  Payload ID: 6667
  Gene Symbol: GLB1
  Gene Name: galactosidase, beta 1
  ENST ID: ENST00000307377
  CDS Start-End: 62-1702
agtcaagtgacgcgaagcggccggcctgggcgccgactgcagagccgggaggctggtggtcatgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatg

SEQ ID NO: 136269 - DNA, 2616 bp, Homo sapiens
  Payload ID: 6667
  Gene Symbol: GLB1
  Gene Name: galactosidase, beta 1
  Uniprot ID: P16278
  ENST ID: ENST00000307363
  CDS Start-End: 146-2179
cacagcggggcggggcgcggggctgagcaggcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaata

SEQ ID NO: 136270 - DNA, 2512 bp, Homo sapiens
  Payload ID: 6667
  Gene Symbol: GLB1
  Gene Name: galactosidase, beta 1
  Uniprot ID: P16278
  ENST ID: ENST00000399402
  CDS Start-End: 133-2076
gggcgggccgggcggggcgcgcgtccttccaggcagctcggtcgcttgtgcgttccgctccggccgccctttgcgcttggatccacttccccatctgtaacgaggtgttgagacgagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaat

SEQ ID NO: 136271 - DNA, 558 bp, Homo sapiens
  Payload ID: 6667
  Gene Symbol: GLB1
  Gene Name: galactosidase, beta 1
  ENST ID: ENST00000436768
  CDS Start-End: 118-558
aggcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccctctgttgctggttctgctgcttctgggccctacgcgcggcttgcgctctcgattccttccttgggcttttcatctgccacggcaagcgcctaagtctcagctgccgcttcacaaaagaggtaccaagactgcaccgaatgagcacgcaagcagcaacaggagtgggagaagaaggaggcggcagcagtggaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttct

SEQ ID NO: 136272 - DNA, 569 bp, Homo sapiens
  Payload ID: 6667
  Gene Symbol: GLB1
  Gene Name: galactosidase, beta 1
  ENST ID: ENST00000438227
  CDS Start-End: 62-187
agtcaagtgacgcgaagcggccggcctgggcgccgactgcagagccgggaggctggtggtcatgccggggttcctggttcgcatcctccctctgttgctggttctgctgcttctgggccctacgcgcggcttgcgcattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatact

SEQ ID NO: 136273 - DNA, 540 bp, Homo sapiens
  Payload ID: 6667
  Gene Symbol: GLB1
  Gene Name: galactosidase, beta 1
  ENST ID: ENST00000450835
  CDS Start-End: 234-540
gcttgtgcgttccgctccggccgccctttgcgcttggatccacttccccatctgtaacgaggtgttgagacgagtctcgattccttccttgggcttttcatctgccacggcaagcgcctaagtctcagctgccgcttcacaaaagaggtaccaagactgcaccgaatgagcacgcaagcagcaacaggagtgggagaagaaggaggcggcagcagtggaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgg

SEQ ID NO: 136274 - DNA, 631 bp, Homo sapiens
  Payload ID: 6667
  Gene Symbol: GLB1
  Gene Name: galactosidase, beta 1
  ENST ID: ENST00000446732
  CDS Start-End: 18-272
agaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgt

SEQ ID NO: 136275 - DNA, 626 bp, Homo sapiens
  Payload ID: 6667
  Gene Symbol: GLB1
  Gene Name: galactosidase, beta 1
  ENST ID: ENST00000440656
  CDS Start-End: 285-626
agtcaagtgacgcgaagcggccggcctgggcgccgactgcagagccgggaggctggtggtcatgccggggttcctggttcgcatcctccctctgttgctggttctgctgcttctgggccctacgcgcggcttgcgcgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggt

SEQ ID NO: 136276 - DNA, 591 bp, Homo sapiens
  Payload ID: 6667
  Gene Symbol: GLB1
  Gene Name: galactosidase, beta 1
  ENST ID: ENST00000415454
  CDS Start-End: 37-591
ctgggcgccgactgcagagccgggaggctggtggtcatgccggggttcctggttcgcatcctccctctgttgctggttctgctgcttctgggccctacgcgcggcttgcgcgttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcact

SEQ ID NO: 136277 - DNA, 2745 bp, Homo sapiens
  Payload ID: 6668
  Gene Symbol: GLB1L
  Gene Name: galactosidase, beta 1-like
  Uniprot ID: Q6UWU2
  ENST ID: ENST00000295759
  CDS Start-End: 315-2279
atcagtccgcgccggcgtaacggcccgcggtatctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggttccctcccaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagacttccttgccgcagtggactcctggttcaaggtcttgctgcccaagatatatccatggctttatcacaatgggggcaacatcattagcattcaggtggagaatgaatatggtagctacagagcctgtgacttcagctacatgaggcacttggctgggctcttccgtgcactgctaggagaaaagatcttgctcttcaccacagatgggcctgaaggactcaagtgtggctccctccggggactctataccactgtagattttggcccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaaaaaaaaaaaagtaacccttggacctgggacatggagtgggcaggatcccttggtgctggccacggtgaccctaaggaactaaaggccacagtgcctctgaatgtaagtacaagtacacattccttgccaaactttattgtgattaaaattccagagacagtacca

SEQ ID NO: 136278 - DNA, 2574 bp, Homo sapiens
  Payload ID: 6668
  Gene Symbol: GLB1L
  Gene Name: galactosidase, beta 1-like
  Uniprot ID: Q6UWU2
  ENST ID: ENST00000392089
  CDS Start-End: 309-2273
gacatcatcagtccgcgccggcgtaacggcccgcggtatctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagacttccttgccgcagtggactcctggttcaaggtcttgctgcccaagatatatccatggctttatcacaatgggggcaacatcattagcattcaggtggagaatgaatatggtagctacagagcctgtgacttcagctacatgaggcacttggctgggctcttccgtgcactgctaggagaaaagatcttgctcttcaccacagatgggcctgaaggactcaagtgtggctccctccggggactctataccactgtagattttggcccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaa

SEQ ID NO: 136279 - DNA, 2042 bp, Homo sapiens
  Payload ID: 6668
  Gene Symbol: GLB1L
  Gene Name: galactosidase, beta 1-like
  Uniprot ID: Q6UWU2
  ENST ID: ENST00000409640
  CDS Start-End: 42-1736
gtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaaaaaaa

SEQ ID NO: 136280 - DNA, 556 bp, Homo sapiens
  Payload ID: 6668
  Gene Symbol: GLB1L
  Gene Name: galactosidase, beta 1-like
  ENST ID: ENST00000440853
  CDS Start-End: 1-556
tgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagacttccttgccgcagtggactcctggttcaaggtcttgctgcccaagatatatccatggctttatcacaatgggggcaacatcattagcattcaggtggagaatgaatatggtagctacagagcctgtgacttcagctacatgaggcacttggctgggctcttccgtgcactgctaggagaaaagatcttgctcttcaccacagatgggcctgaaggactcaagtgtggctccctccggggactctataccactgtagattttggcccaggtctcaagcaagggctgggagtggagtctggggaaag

SEQ ID NO: 136281 - DNA, 609 bp, Homo sapiens
  Payload ID: 6668
  Gene Symbol: GLB1L
  Gene Name: galactosidase, beta 1-like
  ENST ID: ENST00000432839
  CDS Start-End: 583-609
atctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggagtagagacagggttttgccctgttggccaagctggtcttgaactcctgacctcaagtgatccacccgcctcggcctcccaaagtgttgggattacaggcgtgagccatcgtgcccagccagattctccatttctaacaagttcccaggtgatgtcgatgaagctggttcgtgaactgcactttaacatgatgtagaaattttacaaactagtagagtaagggggtggctgcaggctggagaggaagtccaggctaaacgcctggcaacttgaggtggtttccgcccccttgctcgctgaggttccctcccaggaatccgacacgtgacggtctgtccgccgtctcagactagaggagcgctgtaaacgccatggctcccaagaagctgtcctgcctt

SEQ ID NO: 136282 - DNA, 635 bp, Homo sapiens
  Payload ID: 6668
  Gene Symbol: GLB1L
  Gene Name: galactosidase, beta 1-like
  ENST ID: ENST00000447002
  CDS Start-End: 26-178
agactagaggagcgctgtaaacgccatggctcccaagaagctgtcctgccttcgttccctgctgctgccgctcagcctgacgctactgctgccccagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttgg

SEQ ID NO: 136283 - DNA, 888 bp, Homo sapiens
  Payload ID: 6668
  Gene Symbol: GLB1L
  Gene Name: galactosidase, beta 1-like
  ENST ID: ENST00000428427
  CDS Start-End: 545-888
gacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggagagacagggttttgccctgttggccaagctggtcttgaactcctgacctcaagtgatccacccgcctcggcctcccaaagtgttgggattacaggcgtgagccatcgtgcccagccagattctccatttctaacaagttcccaggtgatgtcgatgaagctggttcgtgaactgcactttaacatgatgtagaaattttacaaactagtagagtaagggggtggctgcaggctggagaggaagtccaggctaaacgcctggcaacttgaggtggtttccgcccccttgctcgctgaggttccctcccaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgtt

SEQ ID NO: 136284 - DNA, 517 bp, Homo sapiens
  Payload ID: 6668
  Gene Symbol: GLB1L
  Gene Name: galactosidase, beta 1-like
  ENST ID: ENST00000424620
  CDS Start-End: 439-517
ggtatctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggagtagagacagggttttgccctgttggccaagctggtcttgaactcctgacctcaagtgatccacccgcctcggcctcccaaagtgttgggattacaggcgtgagccatcgtgcccagccagattctccatttctaacaagttcccaggtgatgtcgatgaagctggaatccgacacgtgacggtctgtccgccgtctcagactagaggagcgctgtaaacgccatggctcccaagaagctgtcctgccttcgttccctgctgctgccgctcagcctgacgctactgctgccccaggcagaca

SEQ ID NO: 136285 - DNA, 3152 bp, Homo sapiens
  Payload ID: 6669
  Gene Symbol: GLB1L2
  Gene Name: galactosidase, beta 1-like 2
  Uniprot ID: Q8IW92
  ENST ID: ENST00000339772
  CDS Start-End: 189-2099
agccccgcccccgcttgcgcgaggcctagggctgcaggcgcggagccgcgagccccagccaatgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcactggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatc

SEQ ID NO: 136286 - DNA, 3365 bp, Homo sapiens
  Payload ID: 6669
  Gene Symbol: GLB1L2
  Gene Name: galactosidase, beta 1-like 2
  Uniprot ID: Q8IW92
  ENST ID: ENST00000535456
  CDS Start-End: 189-2099
agccccgcccccgcttgcgcgaggcctagggctgcaggcgcggagccgcgagccccagccaatgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggagttccctcccagaaacacccacattacctgctttcttcttgggtagcttgtccatcagctccaccccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcactggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgccccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcaca

SEQ ID NO: 136287 - DNA, 3566 bp, Homo sapiens
  Payload ID: 6670
  Gene Symbol: GLB1L3
  Gene Name: galactosidase, beta 1-like 3
  Uniprot ID: Q8NCI6
  ENST ID: ENST00000389887
  CDS Start-End: 2497-3438
gcggccctagtggctggtctttcctgtgcttgggatgttggccttgtagagttacttctgtaatctcaagacagaaactgacagctttgtttgatcaaaattgttacttcaccttgcacattttcaagagttctacaggtttaatgagcacagaaatctgggggaactttcactctccagggctccttcatagaggttctcaaatactccatcagcagaggggagccccagatggcaaaaggacacaggatatgtcatctttcaaatgaaccaataatccattatttgattcttctacctttgtcaaaattcctccagcaacgcctgcagaaaatcacaattcttgatacatagcttgttccaataaagcaccacagcatttctagtgactgcaggcccagctgtcaaactctttcaacttgatagagaatatgtacacaaaacctatagctgtcatcatacttaatagtgaaaaacagaatgttttccagctgacactggggacaaggtaacagtgtcagttcctgccgctcttattcaacacagaaattttagtcatcatactaagacacacaaaaaaaggaataaaaagccacgcagactggaaaggtagaaataaaactctccatatttgcagatgacatgattatctacatggaaaatgccaagtaatacacaaataacctcttaaaattaataggtgagtttgccaaggtcacaggatatgagatcaacatgagaaacacaatcacatttctgtatgctaacaacaaacatgtaaaaactgaaataaaaataataacagtttaaatctcttgagagcaaaggaaatatttaagtataaacctaacaaaacgtgataggatctgatgttgaaaaaatcacacaattctgatgaaagaagtgaaaaaaaaaaaactatttaaatagacagacataccatgttcgtgggttggaagattcaacataataaggatacaattctcaatttgatccataggttgattgcaattcctctcgaaataccaacatggctttttgtagaaacagacaagtttattctaaattttatgtgggaaggcacaagccctagaatactttaaacttgacaaagaagaataaagtgtgtggctgtaaaaccaaactgtaaaaaattaacagttcattgcttgcagtcgaaaaaatgaggaaaagatggacgatctaggaaactttcagggagctaaggtgtcggagagcaaagtatccttgtaaggaatgagacaagataaactccctcccccacacacagtattttcagagaactacattcttggtttcaacctgatgtcataggctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggccgctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagggagccagtatagatgcaggactgctctcagatgcctcacaagcagcaacttcttcctccttatagttcttatctgtgattcttccataattttgtccttctaagcttctgatgcactgaattatgtaaagtgcattcccttcaccagcttgtgcaccctattctgtaactgataataaatggttggtattgca

SEQ ID NO: 136288 - DNA, 2583 bp, Homo sapiens
  Payload ID: 6670
  Gene Symbol: GLB1L3
  Gene Name: galactosidase, beta 1-like 3
  Uniprot ID: Q8NCI6
  ENST ID: ENST00000431683
  CDS Start-End: 1-1962
atgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggccgctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagagagataagccccttctgattatggaatactgggtcggctggttcgacagatggggagataagcaccatgttaaagatgcaaaggaggttgaacatgctgtgtctgaattcatcaaatatgagatctccttcaatgtatatatgttccatggtggaaccaactttggtttcatgaacggggccacatatttcgggaagcactcgggcattgtcaccagctatgactatgatgcagtgctcacggaggctggagattacacagaaaaatatctgaagcttcaaaaactctttcaatctgtctcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggactgccgatacctgaggatcctggtggagaatcaaggacgagtcaatttttcatggcaaatacagaatgagcagaaaggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtgaataaaataaaaacaagtttc

SEQ ID NO: 136289 - DNA, 1279 bp, Homo sapiens
  Payload ID: 6670
  Gene Symbol: GLB1L3
  Gene Name: galactosidase, beta 1-like 3
  ENST ID: ENST00000455971
  CDS Start-End: 1-560
tgttaaagatgcaaagggttgaacatgctgtgtctgaattcatcaaatatgagatctccttcaatgtatatatgttccatggtggaaccaactttggtttcatgaacggggccacatatttcgggaagcactcgggcattgtcaccagctatgactatgatgcagtgctcacggaggctggagattacacagaaaaatatctgaagcttcaaaaactctttcaatctgtctcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttca

SEQ ID NO: 136290 - DNA, 3883 bp, Homo sapiens
  Payload ID: 6671
  Gene Symbol: GALC
  Gene Name: galactosylceramidase
  ENST ID: ENST00000261304
  CDS Start-End: 108-2165
actcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcagtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 136291 - DNA, 2054 bp, Homo sapiens
  Payload ID: 6671
  Gene Symbol: GALC
  Gene Name: galactosylceramidase
  ENST ID: ENST00000393568
  CDS Start-End: 15-2003
atgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcgggccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttgg

SEQ ID NO: 136292 - DNA, 2547 bp, Homo sapiens
  Payload ID: 6671
  Gene Symbol: GALC
  Gene Name: galactosylceramidase
  ENST ID: ENST00000393569
  CDS Start-End: 167-2146
gtgcttattaacttttctctcagtccctcactctgctgctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgt

SEQ ID NO: 136293 - DNA, 2528 bp, Homo sapiens
  Payload ID: 6671
  Gene Symbol: GALC
  Gene Name: galactosylceramidase
  Uniprot ID: P54803
  ENST ID: ENST00000544807
  CDS Start-End: 509-2278
agtcagcaggcggttggggcgggcccgctgcggggctggggcgggtgctttctcgtttaacacgaaccagacaggcagttaggtttgaacaaatgaggatccggaggtccagagagtataggtgcagagagtaaagtgacaggtctaagtagtgaagtagccggggctggaaccctcgtcccaggcagtggggcacaggctgtcttcatcgcggagatggcagtcggggagcgtcgctccagaaagggccagggagtgcgggagcgtccgtgtgcgaaagagaacgccccagtgggatgctttggctgtgtctctcccttttggaggagttggtgggtggtggagtcgttaagtcccgtgcagttgttagtgcagggtaagaatgggctcctccagagagggtagcgccgaataggatttcgtttggaggcaggactggtgcctcaaggtctctttaaaaggaagataagcgagcggcctgaaactaccgggtactccctctgggcccatgggcttcatggtggccgacctttgggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgat

SEQ ID NO: 136294 - DNA, 2067 bp, Homo sapiens
  Payload ID: 6671
  Gene Symbol: GALC
  Gene Name: galactosylceramidase
  ENST ID: ENST00000555000
  CDS Start-End: 157-1461
gagatgacacctctccctgggttgattagggaagtcttttagaggaggtgatgtgtaatttgaatcttcaagaacggatggataggaactctccactttgctaaggcaggggcatatcatgtgcaaagaactgaagattgagagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaaggtggctggaagaaggaagaaaacctgatatagccaatgctgttgtagtcgtttcctcagcctcatctcactgtgctgtggtctgtcctcacatgtgcactgagtctcgctctgtcacccaggctggaatgcattggctccatctcagctcactgcaacctccgcttcccgggttcaagtgattctcctgcctcagcctcctgagtagctgggattacagttctggcggctagaagttcaagatcaagatgttggcaggactggttcttccaggcttctctcctttgcttatagatgaccactgtcttcttgcatccccacatcatcttcaattctgtatatgtctatgccctaattttctcttcttataaggataccagtcacactggattagggcccaccccagtgacctattttaacttaattatacctctttaaagaccctagctccacatatagtcacattctgaggtactgagggttgacttcaacataggaatttaaaggtaggggtagggacacaattcagctcgtagctaagacactttgcatggagtccggagtctttcaaaatcaggccttgatagttcaaaagtaaatgctggaaatgacctacataggaaaaaaaaaagat

SEQ ID NO: 136295 - DNA, 554 bp, Homo sapiens
  Payload ID: 6671
  Gene Symbol: GALC
  Gene Name: galactosylceramidase
  ENST ID: ENST00000555179
  CDS Start-End: 1-217
caaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatt

SEQ ID NO: 136296 - DNA, 717 bp, Homo sapiens
  Payload ID: 6671
  Gene Symbol: GALC
  Gene Name: galactosylceramidase
  ENST ID: ENST00000554372
  CDS Start-End: 9-347
cccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacatattataggctaaaggtgtgggttctgagaacagggctcacgagtccagggattcatatccagcgttgaaaagctgaaagttgagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaag

SEQ ID NO: 136297 - DNA, 595 bp, Homo sapiens
  Payload ID: 6671
  Gene Symbol: GALC
  Gene Name: galactosylceramidase
  ENST ID: ENST00000556879
  CDS Start-End: 1-189
aaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggactggtgcctcaaggtctctttaaaaggaagataagcgagcggcctgaaactaccgggtactccctctgggcccatgggcttcatggtggccgacctttgggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctgga

SEQ ID NO: 136298 - DNA, 1874 bp, Homo sapiens
  Payload ID: 6671
  Gene Symbol: GALC
  Gene Name: galactosylceramidase
  ENST ID: ENST00000557316
  CDS Start-End: 7-642
cacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaaggtttttggagaataggtggtatttggttacatgaatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttag

SEQ ID NO: 136299 - DNA, 1221 bp, Homo sapiens
  Payload ID: 6671
  Gene Symbol: GALC
  Gene Name: galactosylceramidase
  ENST ID: ENST00000622264
  CDS Start-End: 1-1214
ggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatggtaaacttttgttgttgctattggattaactcacttctttactattggaaaaataaaatataaaactgaa

SEQ ID NO: 136300 - DNA, 10044 bp, Homo sapiens
  Payload ID: 6672
  Gene Symbol: GALR1
  Gene Name: galanin receptor 1
  Uniprot ID: P47211
  ENST ID: ENST00000299727
  CDS Start-End: 1-1050
atggagctggcggtcgggaacctcagcgagggcaacgcgagctggccggagccccccgccccggagcccgggccgctgttcggcatcggcgtggagaacttcgtcacgctggtggtgttcggcctgatcttcgcgctgggtgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaagtaaaagtcgaatagacaccccaccatcaaccaattgtactcatgtgtgataaaagatagagtatccttatggttgagtttccatataagtggaccagacacagaaacaaacagaatgagctagtaagcgatgctgcaacttgttatcttaacaagaattcaagtcgttttaattaaatcccacgtgtgttaaaaagtactttgatccatttaggaaattcctaggtctagtgagaattatttttcaattttattttagttctaaattatgtttcagaaacaaaagacaatgctgtacagttttattcctcttcagacatgaaagggaacatatatattccatatatatgttcaactcttcatagattgtgaactggcccatcaatatggtcaggaatatttgcagtctacattttaaagccaatttatttagaaaaaaaaatttgagctttaattctttaattttaagagaagtaatattgtgaactatgtattttaaaatatgatcatggacacacaatgatgaattttttggccatttacatagacatatctattaagtggaaagaaggctttctgaagtctgtttgcacaggtggcatttgcttccaattgtagctagcgcacagagctttggaagcctgtcattatgagatacagtcggtttacctcaggagtcaattcagtgttgtactggtgacctgggatgcagtagtaggcactgttgattcaaatttatcctgtgaaactggctttatagagttaacaaaacagagtcagagaccactgtcttaacagtggaagatgcaaataagtttttgagaataaaactggattttgaaattttacattagtacttgacaaaagttttcattttgccttgaatggaacctactaaaaagagagatgaaaaaaaatcagcgaggttgatgtagataataatttctatgggaccaaagactagacagaattcagtaagtcacatgaagtaatggtcatgcctgtacataaagcatatttcatgtttgatttagatgacattcaaaaaaaatcatgggactgaatatacctggggtatcctatcttgtacaaatgcatgctttttcattaaatttgtaatgatgtttaatgaacatttccaccaaacattatttcctctaaaaatgttaatttggggttaaaaccatcaccatttgaatttcaaatgtagttttcatgacaattttatattgatgtgtgtttacaatgagaaaatggcatgaaaatattaaattgtcttgtatcggaaaagtacttttcagactgtaagactttgatatgttttaggaggcaacaaaagcaagaagttttttttttgtttgtttgttaaaaaggatttggccaagcacagtggctcatgcctgtaattccagcactttgggaggtccagctgtgtggaatgtacttgagctcaggagtttgagaccagtgtgggcaacatggcaaaactcggtctctactaaaaatacaaaaattagctgggtgtggtggcgcacgcctgtagtttcagctactctggaggctgatgtgggggatcacctgagcccgggaggtccaggatgcagtcagtcaagactgcaccactgcacttcagcctggatgacagagtaagactctgtctaaaatatatatatatatgtgtgtgtgtgtgtgtgtgtgtgtgtgtgtgtgtaatgtacctctgtgccaaatcagcactccacatgaaacatcaaattttagataaaaatgcaaacttgacataagcctttggcatgctaatttttttagctcattcacttactttcactaatcatatttcagtgactagtgtttacatttgcaatgttattaataactctctggataaaaggaaagaaaaacgttagaaagattttgaagtgatgtattatgtttgttgactagaagaagaaattgtgtttatgtgtaagtgagggtcttaaagaatatgtcctttgcatcgaatgttttttgcactttattcaaatatataggagcagaaaaattttatcctgacgatgatacttcctgtgatttgtggaacttgaagttgctgttgcaaactccagaacaacttctttgggtgtgaactcacaaaactgtgtaaagaagtgccttcttgttgtgtttgagtttgcatgaatggaaatgatttcttgcaccatggctatttctttgttttctccttctgatctgtaagcatataaatggaagtatttaaaaaaatactgtagctaatgttgctattttctagaggcatgccgaaaatgtgctgtgcctttggtccttcccagatgctactggcacgtctgaagcttgaggcatggtacaaaaagtaatagcttgcgcttgaaacccccccccccccgccactttgctaaatgtaaatgctaattgttgcattttacagttagataggatatacttcctgcatattgtcattctaatcaattcctcttactcagagttttggctgagtctacttctaaaacaaattttgatagggataatgacatcttctgcaaagatctaaacctctacaaaattttctgaataaagagtttcagaagaactcgtaaacagaatgaaattaaccagagaagtataggagtgtgttgcgtttgccaagcatctgcttcccagctagatttccccctaatatacaatgaccaattctgaagcaccttcttttccgtcactaaataaagacagcttcccaaggacacactttttctcccagcatcaggttgagggagaaatattgcttatacctttgaagtcaggctgcttgaaactcacattttcagtttacttcaaagaaaactgatgctttctaagcagatttggctgtctcagtgcccaaggcagctgttattttcctaggctttttgctttcacgtaaggagacaggctttgggatatttagtagctgaaatgcttgctgtttcacatgcataagcaaccatttcagtgtcctgctgatgaatacagtgatgtggatggaaacgttttcttgtcctatatcctggggataggaaacagattctctgtgctcttctgaccgggtatgtactcagcaacatgggggactgaggccattttctgaatactttaggtaaattacttttgcttttaactaaattgttttattttacacattgggagtaaaaccatttccgccccatcccaatctcttgtgcttttatcttttttatcctaactcacttctatccagatttcctctcgataatatttaccacagataaattcatctttcagcgcagatataacaaatcagagtggggaggagagatgcttaaggaactgcatgagtcatgcaaggctcagaacttcttgtggctcaactcgaaatcatattgcattcctgcattctcccagatgctttgaggcagtgcagcgatcattctaatatgttaactgagacccaagatctcagcaggagaggacagcttatccaagcatccctttccttttcagtcatggccatggctatctgtaaacaccaaaatgctcatgctgaagcagcattacattgaggaaaataacctattgggcagcttcatcatgttcttgctttaaatgatttatcaaatacatgtatgtaaactacatagtcactaactgcgaaaatacatcaatgtggctacttcctctggaaagttactgtctaaaatttgtaaattttaatcttcactgttgcacatattttccatgtcttaaatttgtaagtgggtttctatgaaaggtaatcgtattcttcttgaccattaaaaatgttgcatgtaaggctatttctcaagtagatgttaatgacttgtttaattattgacttacttattttaaaagctgtatgtagtaagaacaagtaggtggtttaaaattcagatagttacatgttggcctggaaagaacaaaattatgaaatggtaattatatctgattttatttaaccatattttaatattttctcttttagaagtggaaaagttgagcctgaggaagaatttaaaatgcttaagacatctttgatgggggctgtatttgcattaggcagaggtgtctaaggagagtgtatcgtgtattgtgatgcattagcaggatgttttgttcatcgacttgtgaaagtgctgtggataatagatggtggtttcttttcttagtgtggcaggttcactcacattcatgtttttgactttagctgccatcctggggttctgagggtagcatgtctgtttgactgggcaagaccctcacataccttggcaggccctggctttcgtttctctgtggtgcctggtgctactcacagggctgactcacgggcagatgctccccatccttccccataggccctgttcccgcatccgatgattctcaggttttgttctaggtgcagaaatagtgggagaggccataatcgtgaatgatgaataagaagggaaggtggggccgggcatgtgacttatgcctgtaatcccagcactttgggaggccgaggcaggtggatcacctgaggtcgggagttcgagaccagcctgaccaacatggagaaaacccgtctctactaaaaatacaaaaattagctgggggcacacatgtgtgatcccagctactcaggaggttgaggcaggagaattgcttgaacccgggaggtggaggttgcaatgagcctagattgcaccattgcactccagcctgggcaacaagagtgaaactctgtctcaaaaaaataaaaattaaaaaaaaaaaagaaggtggccagtgagggttttatctttgtattcactggaaataacctcagctgaattttctctctgaatcttttcaatgttggctccatttgccatactcagacaattgcttgaagagctgaactgttagctcaagatttcgttggcactgttggatagaaagcctctccttttctgctggagaagagatttctcaggccaagttgtgtagctccaaattctccgcaattagagaaggcacagtaaagaaaagatcccttgctgatggaatggactggaactgagctccactgtttaaatttttgactctcaggtagtggtgatcgttatggtaacccatgaactcggatgaatttcggggcctgctgtgggttttctatgggacaccatataccacagtactgtatttcaaaatattggatattgattatgaacactggaactatttatgtgtcatcattccaaagaccattgtgatctatgaagctcctttatttgctggctagattgtccaaaaacaagctcacttgtttttgggcaatctagccaaggtgtcacataatggagaaaaatgcagatggtcctgtggctggtgtgaatgaagaatgacctgggcccaacatagaacttttccagtatggtgagcatcaaagtaggcagacatccaaaagccaagtgaagggcagatagatccccaggtgccacccaggctctgcaggcaaagctctcagggccccatttgtgtttgtgtggcctgcactgtgtaagtgtcgttcccctaggacttctgcaatgggataccaaagatgacgtgtaaggccttcagtatataatggacttgtgccaagtacctaagggttcactgccttgtttgaggaatcgcagagcatcatttctgattggttcttagagcctgcatcttgtaccactgggacttctggagacctctggggaccgttgactatgctgggagggtgcagaaatgaagctgatggcagaagcaggctcccagctcctcttcttctgctcagccaggtgattcttacctccattggcctttggatgtctgcgtaataatttgttgagaatcattagagaacaactaatccaaaaaatctatcatcctttatttgtgttgactttctgattatgccttcattcactctttttattacttatacacatgtctgtttttattcttccctactcttttcttaaagttggtcatatttctacacttgagatcttccagtttctgtgaatgttgaggggttcacaaagtggcttggcctcagacctctatatccttgttgttctgtttggacttaggacttttttcctggctatcctgccaatacttttccatctaacagaaacgcaagcttcaagagcaagttatttttataacagatcatgtgagcaattcctccatagcattggttgtagaacaggtcagttggcatgtggcctcctgagggccttgcatggggttctggacccagcgggggccacatctctgagaattcgttccctgtgggtgtctggggtgcatcgttacttctgagatgttatgactcagcagatgagatttgtccgtctgctcagtgagaggaattccaatgctgggtcttgactcccgctgcagggagctctctgggcccgggcatgttggatggagttgtgatgggtgtgcctccctcggacttactctggccaggaactgcatctgctcctctaaggagatttgagcaggtgaatggagtttctgtcattcctggtctagagttcatgtgtgaaggtcaaatataggtggggacttggcagcacacaactctgagtgaaagacacgatcagcgtgatagacaggtgtcttgctatgtgacttgccattgcggtcactggttatacaaagtctctgtttagaaatagcaaagatccaagaaagcagaagagtgggggtgggagtggggctaaatgtgttgctcttcagtggaaatctgcccattttgttgaaaagaaaggaaacagggtacacaaatgctgtttgggaacattgtgtcaggatcacctagctttgacgatgagagtgttttttaaaacggaaaccatgtcattttccttctagagagaatttcctggtatgtcaatgtagcttcagaaataggtctcagtgttctggctcagggcgaggttacaaaagaggcttcggtagcgtcctcaggcccgcgtgccctgtgttcttaacagcctcatggggcctagaggaacttttacatggtagacactgagtgaatacacagattcctagatttgagatattttcaaaatagggctagcatgtataaagaatcaaacttagtcattccattgaagtgaaattggattataatttagaaatatttataagccagaaatggttgtgtaaatgttagttttcatattttggttttctaagagtcacattttattgccatatagcacaaaatttgacaatgaggtatagaaatccaaaattttcttgggtacaattgaacaaatcttttaatctcttcagttctatctgcctaagtgaggagagtagttgtggagcattgtagaaaggataaaatgaacattaggatactgagggtttggtctgaattctgttttttcattgctactggaagtgctgtctttggtatcctcatgcatacaagaaggatttggaaaatgtcagtgagtttgaaactggctgtacagttgaatgagctgggcagttgaaagtacccgtgatgctctggccttaccttagatcagagattcttatattttatcaagcatcagaatcacctgcagagcttgttgaatgcagattgttggccacatctccagaatttctcattcagtagatttgggatggagcccaacgatttgcagctggtccagagaccaccttgtgagatctactacctgatttaattggtttgaaggtgaaggtggagtccaggctttttaaaacagtgtctgtattttcagagcagataaccaatcaaattgagcagatggtcttttaaagtctaagcttctatggttctgtgaaaaaaattgtttacatggaatttaaatcattcagaatttttattgcttacattgatcagatccataaaatatctgtttaactattacattaccctagctacagaaatttgtaagttttcaaaagcatgaaggagtttaataacttgtaagactttcagagattgttataatttttgcctcaaaaaaataaaataaaatagcttggtggaaaagagcacctatgcattcaatttgtttccctcaaatgctaagggttaaaatagtactcaaaattgttagatgtgaagttttgaacccagtgtttaaactcagtgtttaaatatttgcatgtctttctatgtgactgctaatttttaactacattattatctctaagagataaataaactttccctgtacttaaagtttttaaattaagtatcttctgataacataagtagtatgagtaaggaaaaaaaatctatgtgtactgtatttttaaattttaataaggtttgatatggtttggctctgtgtctccacccaaatctcaccttgaattgtaataatcctcacgtgtcaaggaccagcaggtggagataattgaattatggggccggtttctctcatactgttcttgcgatagtgagttctcaggagatctgatggttttataagcatctagcatttcccctgctggtacattctctcttcgcctgctgccatccatgtaagatgtgacttgctcctccttgctctctgccatgattgtgaggcttccccaccacttggaaatgtaagtcaattaaaccactttctttagtaaattgcccagtctcgggtatgtctttatcagcaatgtgaaaacggactaatacaacgtgattgtttaaatgctgatatgaaagcagtgctgaatgtggatcttcttatgccagatactgttataattattctctagagagctggccatacaatttatctcattatttatagatctagcatgaatgccagtaagctgacaaagccaaaagccaaaaactaagagtttgtattaatccagttaatgccaaatctagtcatcctccatcatcctacctctgtgttctgcatgaaatataattggcctttgtgatggaaccagttttcttgcattgaaaataaaatttgttcctc

SEQ ID NO: 136301 - DNA, 1364 bp, Homo sapiens
  Payload ID: 6673
  Gene Symbol: GALR2
  Gene Name: galanin receptor 2
  Uniprot ID: O43603
  ENST ID: ENST00000329003
  CDS Start-End: 91-1254
gagttgcagcggccgcagccccgggagcttcccgctcgcggagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctgaaagcacttagcgggcgcgctgggatgtcacagagttggagtcattgttgggggaccgtggggagagctttgcctgttaataaaacgcacaaaccatttcacacacagtga

SEQ ID NO: 136302 - DNA, 1157 bp, Homo sapiens
  Payload ID: 6674
  Gene Symbol: GALR3
  Gene Name: galanin receptor 3
  Uniprot ID: O60755
  ENST ID: ENST00000249041
  CDS Start-End: 26-1132
tcccaggtgcccgtctgatggggagatggctgatgcccagaacatttcactggacagcccagggagtgtgggggccgtggcagtgcctgtggtctttgccctaatcttcctgctgggcacagtgggcaatgggctggtgctggcagtgctcctgcagcctggcccgagtgcctggcaggagcctggcagcaccacggacctgttcatcctcaacctggcggtggctgacctctgcttcatcctgtgctgcgtgcccttccaggccaccatctacacgctggatgcctggctctttggggccctcgtctgcaaggccgtgcacctgctcatctacctcaccatgtacgccagcagctttacgctggctgctgtctccgtggacaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggccgccgtgggtcccgcgggcgcggcggcggccgaggcgcggcggagggcgacgggccgcgcggggcgcgccatgctggcggtggccgcgctctacgcgctctgctggggtccgcaccacgcgctcatcctgtgcttctggtacggccgcttcgccttcagcccggccacctacgcctgccgcctggcctcacactgcctggcctacgccaactcctgcctcaacccgctcgtctacgcgctcgcctcgcgccacttccgcgcgcgcttccgccgcctgtggccgtgcggccgccgacgccgccaccgtgcccgccgcgccttgcgtcgcgtccgccccgcgtcctcgggcccacccggctgccccggagacgcccggcctagcgggaggctgctggctggtggcggccagggcccggagcccagggagggacccgtccacggcggagaggctgcccgaggaccggaataaaccctgccgcctggactccgcctgt

SEQ ID NO: 136303 - DNA, 818 bp, Homo sapiens
  Payload ID: 6675
  Gene Symbol: GAL
  Gene Name: galanin/GMAP prepropeptide
  Uniprot ID: P22466
  ENST ID: ENST00000265643
  CDS Start-End: 259-630
ccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaatta

SEQ ID NO: 136304 - DNA, 938 bp, Homo sapiens
  Payload ID: 6676
  Gene Symbol: GALP
  Gene Name: galanin-like peptide
  Uniprot ID: Q9UBC7
  ENST ID: ENST00000357330
  CDS Start-End: 83-433
gaggagccagagagagctgcggagagctgccagctgcagcgggcgtgttccgcagctgtaggcacctgtcgtcctgccttcgatggctcctccctccgtccccctggtcctcctcctcgtcctcttgctgagcctggcagagactccagcatccgcacctgcccaccggggacgaggaggctggaccctcaatagtgctggctaccttctgggtcccgtcctccaccttccccaaatgggtgaccaagacggaaagagggagacagcccttgagatcctagacctgtggaaggccatcgacgggctcccctactcccaccctccacagccctccaagaggaatgtgatggagacgtttgccaaaccagagattggagatctgggcatgctcagcatgaaaattcccaaggaggaagatgtcctgaagtcatagatgtcttcaaatccctgttcctatccttcttctccagctcctcctgctccctctgaaaccttttctaggtaccctatgctgagactaagatcctgaagttaaatacccaggtctcatgaagacattgtaaagcatttgaattattctaaaaaatttctggagtttcttaggttttattgattcatccttgaaatcagtataatgtgctattaatggaaccaatagtaattcgaggactagttgggagattctggggtaatcagggaatattcctgcaacacatttaaaggaattgtgttcttttggaatcatcccaattataacacgagctattgcataatacaaataaccctcttaagtctgagagtctgtgtctttatttgaaaagattcttcaaattgcgtacttactcctccatattctttcaacccacatgagtctcctcgagaagtgaggagaggcagtttggagcagaatggagagaataaaatgtttcttgtcaaac

SEQ ID NO: 136305 - DNA, 889 bp, Homo sapiens
  Payload ID: 6676
  Gene Symbol: GALP
  Gene Name: galanin-like peptide
  Uniprot ID: Q9UBC7
  ENST ID: ENST00000440823
  CDS Start-End: 83-232
gaggagccagagagagctgcggagagctgccagctgcagcgggcgtgttccgcagctgtaggcacctgtcgtcctgccttcgatggctcctccctccgtccccctggtcctcctcctcgtcctcttgctgagcctggcagagactccagcatccgcacctgcccaccggtcctccaccttccccaaatgggtgaccaagacggaaagagggagacagcccttgagatcctagacctgtggaaggccatcgacgggctcccctactcccaccctccacagccctccaagaggaatgtgatggagacgtttgccaaaccagagattggagatctgggcatgctcagcatgaaaattcccaaggaggaagatgtcctgaagtcatagatgtcttcaaatccctgttcctatccttcttctccagctcctcctgctccctctgaaaccttttctaggtaccctatgctgagactaagatcctgaagttaaatacccaggtctcatgaagacattgtaaagcatttgaattattctaaaaaatttctggagtttcttaggttttattgattcatccttgaaatcagtataatgtgctattaatggaaccaatagtaattcgaggactagttgggagattctggggtaatcagggaatattcctgcaacacatttaaaggaattgtgttcttttggaatcatcccaattataacacgagctattgcataatacaaataaccctcttaagtctgagagtctgtgtctttatttgaaaagattcttcaaattgcgtacttactcctccatattctttcaacccacatgagtctcctcgagaagtgaggagaggcagtttggagcagaatggagagaataaaatgtttcttgtcaaac

SEQ ID NO: 136306 - DNA, 150 bp, Homo sapiens
  Payload ID: 6676
  Gene Symbol: GALP
  Gene Name: galanin-like peptide
  Uniprot ID: Q9UBC7
  ENST ID: ENST00000590002
  CDS Start-End: 1-150
atggctcctccctccgtccccctggtcctcctcctcgtcctcttgctgagcctggcagagactccagcatccgcacctgcccaccggtcctccaccttccccaaatgggtgaccaagacggaaagagggagacagcccttgagatcctag

SEQ ID NO: 136307 - DNA, 461 bp, Homo sapiens
  Payload ID: 6677
  Gene Symbol: GRIFIN
  Gene Name: galectin-related inter-fiber protein
  Uniprot ID: A4D1Z8
  ENST ID: ENST00000614228
  CDS Start-End: 1-435
atggcagtgcagtctaaagccttctgtgcgggcggcctggcccccggctggaagctgctggtccagggacatgctgactctggagaggacaggttcgagactaacttcttgttggagacgggggacattgccttccacatcaagccccggttctccagcgccactgtggtgggcaatgccttccagtacggccgctggggcccggagcaggtgtctagcatcttcccgctggccccgggggagccctttgagatagaggtcagctgggacgcggagcacttccacgtctacgccccggagcacaaggtgctacagttcccatgccgtcagaggccgctgggcgccaccaccagggtgcgcgtgctgagtgaccactgcctggcccaggtggagctggccaagaggggcctgagctggggggaccggggctactgagtgacacctgcaccccaggagccagc

SEQ ID NO: 136308 - DNA, 804 bp, Homo sapiens
  Payload ID: 6678
  Gene Symbol: GTSF1
  Gene Name: gametocyte specific factor 1
  Uniprot ID: Q8WW33
  ENST ID: ENST00000305879
  CDS Start-End: 84-587
gctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattg

SEQ ID NO: 136309 - DNA, 1621 bp, Homo sapiens
  Payload ID: 6678
  Gene Symbol: GTSF1
  Gene Name: gametocyte specific factor 1
  Uniprot ID: Q8WW33
  ENST ID: ENST00000552397
  CDS Start-End: 898-1401
aattttcagaagtttcgtatggggatggttttatataaattcaggtttttcccacaataataaatgtatttagtctcagtgctcaatagaagagatttctaatagaaaaggattcaaactgtgaaaccatttctcttttaatgtttcacattcctgttacagatttgttctcttgtgactctgttatccataatatggacagttcttgagtcctaacattgagaggttttcccttagtgcatagagggaatgagtattaattggagaagcttaaagtattgccactttagcactgaagattgggatgagaggaggtgaaacctcactagaaaaagggacaatgttagtgtggcccttcctgatcatgtttaagaaaagtcatgaaaatggtgaactagtgtttccaagcatattggaagggttgagtgtatactgtctgtcaaagacttccagcatttccaggtcctagagaggaacaagactggtaacctgcctatctgtatttttaagaacccaggaggaaagctttataatagaacattatttctgtgtttatgtataaggggttttttgtttttttaaagacaggatctcactccattgtccaggccaagtgcaatggcacgaacctcatagctcctggacttaagtgatctgcctgcctttgcctcctgagtagctgggactacaggcatgagcccccatgcctggctaagtttgtttttttgtttgtttgtttgtttgtttttgggggggggttgttttgttttttgtagagacgtagtcttgctttgttgccaggctagtctcaaactcctggcttcaagtgatcctcctgcctcagcctcccagagtgctaggattacagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattgctt

SEQ ID NO: 136310 - DNA, 902 bp, Homo sapiens
  Payload ID: 6678
  Gene Symbol: GTSF1
  Gene Name: gametocyte specific factor 1
  ENST ID: ENST00000546931
  CDS Start-End: 34-564
cgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaattcagattctcttgatttcagtctgtgctactgtttgagctaatttttaggtggctagaggattcactttaaaacgtttctccctggatacttgcatttcccaaaaaatgaagtcaccaaattatatgtcaaaaggcttgatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattgcttaata

SEQ ID NO: 136311 - DNA, 617 bp, Homo sapiens
  Payload ID: 6678
  Gene Symbol: GTSF1
  Gene Name: gametocyte specific factor 1
  ENST ID: ENST00000626692
  CDS Start-End: 87-617
gttgctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaattcagattctcttgatttcagtctgtgctactgtttgagctaa

SEQ ID NO: 136312 - DNA, 835 bp, Homo sapiens
  Payload ID: 6679
  Gene Symbol: GTSF1L
  Gene Name: gametocyte specific factor 1-like
  Uniprot ID: Q9H1H1
  ENST ID: ENST00000373003
  CDS Start-End: 305-751
tcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcaggtctcaccctgccttcccagccccgatatctggaatgtcgatggcgctaattgccagcatgtgtttgtccttaagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaa

SEQ ID NO: 136313 - DNA, 459 bp, Homo sapiens
  Payload ID: 6679
  Gene Symbol: GTSF1L
  Gene Name: gametocyte specific factor 1-like
  Uniprot ID: Q9H1H1
  ENST ID: ENST00000373005
  CDS Start-End: 4-375
ctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaa

SEQ ID NO: 136314 - DNA, 2239 bp, Homo sapiens
  Payload ID: 6680
  Gene Symbol: GGN
  Gene Name: gametogenetin
  Uniprot ID: Q86UU5
  ENST ID: ENST00000334928
  CDS Start-End: 134-2092
aaggcctgggggcgaggaacaagacctcggagtatttcaaggggagacctagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcgggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgcactctctgggccttggggctcccctccgccaccaccagagcagatacactcagctcccgggccccggaggcccgcacctgccctgctggcgccgcctacgttcatcttcccagcacccaccaatggcgagcccatgcgcccggggcctccaggcctgcaggagttaccaccgctgccaccgcccacaccgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcggctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgcgctgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagatgccagcagcctgtcaatcactcgccaaggcagtgggtagggtgcagcagggcaggatcgccattaaagcacatcttggaaacaatc

SEQ ID NO: 136315 - DNA, 520 bp, Homo sapiens
  Payload ID: 6680
  Gene Symbol: GGN
  Gene Name: gametogenetin
  ENST ID: ENST00000587676
  CDS Start-End: 342-520
attctaaaggggaggggctaaggagaacaacccaaaggggtggagcttagaaccagaaggcctgggggcgaggaacaagacctcggagtatttcaaggggagacctaggttcgtaaggggccgggctcccgcgggctcgcaggagggcggggcctcgagctccgggggcggggcctacatctcggggtccgccctagttgtctcgcccacttgccttcacccgcacccccgttcttttcggttattttctgctacggcagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggact

SEQ ID NO: 136316 - DNA, 495 bp, Homo sapiens
  Payload ID: 6680
  Gene Symbol: GGN
  Gene Name: gametogenetin
  ENST ID: ENST00000586599
  CDS Start-End: 250-495
tttcaaggggagacctaggttcgtaaggggccgggctcccgcgggctcgcaggagggcggggcctcgagctccgggggcggggcctacatctcggggtccgccctagttgtctcgcccacttgccttcacccgcacccccgttcttttcggttattttctgctacggcagttccctgccctgccccgggcccagggcgccgcggtctgaactctgctcggctggaggactcgaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccg

SEQ ID NO: 136317 - DNA, 1747 bp, Homo sapiens
  Payload ID: 6680
  Gene Symbol: GGN
  Gene Name: gametogenetin
  Uniprot ID: Q86UU5
  ENST ID: ENST00000585737
  CDS Start-End: 125-1498
agaaccagaaggcctgggggcgaggaacaagacctcggagtatttcaaggggagacctagttccctgccctgccccgggcccagggcgccgcggtctgaactctgctcggctggaggactcgtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcgggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgcactctctgggccttggggctcccctccgccaccaccagagcagatacactcagctcccgggccccggaggcccgcacctgccctgctggcgccgcctacgttcatcttcccagcacccaccaatggcgagcccatgcgcccggggcctccaggcctgcaggagttaccaccgctgccaccgcccacaccgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcggctgcgcccatcaagacccgcacgcgcaggaacaagggttcccgtgcagcccggggcgcgacccgtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccag

SEQ ID NO: 136318 - DNA, 2847 bp, Homo sapiens
  Payload ID: 6681
  Gene Symbol: GGNBP2
  Gene Name: gametogenetin binding protein 2
  Uniprot ID: Q9H3C7
  ENST ID: ENST00000613102
  CDS Start-End: 317-2410
accttcccctcgtcccccgccctccttcttccactccccgcggcgcgagcggctgactgcccgtagaggaaacgacattcggagctgcgctcccgcccacgccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaagaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 136319 - DNA, 2847 bp, Homo sapiens; identical to SEQ ID NO: 136318
  Payload ID: 6681
  Gene Symbol: GGNBP2
  Gene Name: gametogenetin binding protein 2
  Uniprot ID: Q9H3C7
  ENST ID: ENST00000621686
  CDS Start-End: 317-2410

SEQ ID NO: 136320 - DNA, 2315 bp, Homo sapiens
  Payload ID: 6681
  Gene Symbol: GGNBP2
  Gene Name: gametogenetin binding protein 2
  ENST ID: ENST00000611219
  CDS Start-End: 293-499
cttcttccactccccgcggcgcgagcggctgactgcccgtagaggaaacgacattcggagctgcgctcccgcccacgccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacggtgagcgggccgggccgggctgggcccgccgctcccctggcagctgtttcccctcctccccctcccccaggccgagcgctgcgcactggagaaagagtgtgttgcaactcctaggcgaggccttctcttcagcaggccccacaaactcgcctttgcagtgggtggctcggtaacctctgtcggccccaagcccagagctccgtacgcactccctctctccagattttccttcttttggaaccttattccttgaccctttccctttaggagacgctgcttttgtcaaagcacacatctcagagaggggttgaaggatcttgggcgtttagggcctaccccatacagaaaccacctaccctcggggaggcttaattacctggtaatgtcgcagctgcactgctacctgtgtattttctgttttaatactggtagctctcaccacataagcttaattactgggggcagagtgacatgctcgtgcacagtcaagattccactaaaatggtttgatttcgttgtaaatagtctcgtattgcctaatgcattaaaactcttgaaatgattgtattgctaggccctttcttcaaaacgggctttcttcgcattatttagtttacaggtggacttttttttttttaaaggaagccaaattattgaatgtgtaagagtactataaaaagctgattgctcatcttgagtgtcaagacccagttccgggtactttattctttagatttggtagtgtagcattatcgaccctctgccctatgttgctgtactgtttcctttaaaaggaaatggctgaaatttgaattgaatctgaacaggaaatgagtgcagttgcttgccacttaagaaatgaaattaaccttttccgaatatcttttgaaatctgcgttttgatgatgctgaagctttggattatacatttgcttatttcgataaggtgcacctaagtctcttcatctcatcagtattcttttgctatcaaaggcagttgatcagttttgttcctcaatatttttttttgcaaatatctaccgaagttttttcaaattttatgtaaaatgcaagtcattgtagagatgccagtctatgcctttatgcttgccagtctcaattaagacttgattgagctgcagtactttaaaaaggattagaagagctattgaatgacttaatttattagaagtttttaagtgacagcatttctaattattcaagtgcatttatttttcatgaaaaaaggtagaatgatttgttctgacataaagtaaatagtgttgatgcattagaaattgtgtgtcttgattatgatttctgtactttttgcattagaagtataatggacttgtatttttaaatagttgaaactagcactgtgatcatattaaataatgcatttctcagtttggacttcagatagggattcatttgttgatattttctttcttctctcccctgctaacataaacacttttctgaagcatatagttatgatatcagcctttaaggtttattgtcccacaatggctgtggagttaaaaaaaaaaattcagtgagtttggatataagattattatttaatgaataatcataacataggaaaacatatcaaaacatagggaaaaccaacataaatagtcttcaaaagacactagttcttggtatattcacataaccacctttgtgaatgcagcacattaatacatctgtcatatagcactttaaaatggccaactttttaagtgcttttatactgtattctctccacaatgatgtgactttccaaaattttccactgaaaaagatgtaaccttgcaatgtggtttagtatggaacttactttgcactgtatctggcggttgaattttgcttttattgtactgtggacttgtgactaaggcaaataaaacttaagctcacttaa

SEQ ID NO: 136321 - DNA, 695 bp, Homo sapiens
  Payload ID: 6681
  Gene Symbol: GGNBP2
  Gene Name: gametogenetin binding protein 2
  ENST ID: ENST00000616019
  CDS Start-End: 222-695
gtgatgggaaacgcagcccggctctcccgtaccctcccgctccgctccctgccccccgtggcgaatgtgctgcgcagcggcgggtgcttacgctcgcggggtttggctgttgcaggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaag

SEQ ID NO: 136322 - DNA, 665 bp, Homo sapiens
  Payload ID: 6681
  Gene Symbol: GGNBP2
  Gene Name: gametogenetin binding protein 2
  ENST ID: ENST00000615952
  CDS Start-End: 1-401
acgacacaaaaggaaaaaataaaaagaagaagaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgtaagtattccatgtggtcttactgtacataactgtttgggaacggggtggatgtgggaggggatagtatttgagggcttaaggtaggtagttgaaggaagcttatgagaaattaagggtagtatttcattattgtttggggacttcatttctgtccttccactcgtggtttatgcaactactctggaacacgtttccatggccgcctctgtctcagtagaagacattataggtattccttgagttacagtggggttacattccaataaacccattataactcaaaaatactgcgagttgaaaatacattcaacatcccaataaaccctttgtaaagttaaaaaaaaaaaa

SEQ ID NO: 136323 - DNA, 665 bp, Homo sapiens; identical to SEQ ID NO: 136322
  Payload ID: 6681
  Gene Symbol: GGNBP2
  Gene Name: gametogenetin binding protein 2
  ENST ID: ENST00000632761
  CDS Start-End: 1-401

SEQ ID NO: 136324 - DNA, 695 bp, Homo sapiens; identical to SEQ ID NO: 136321
  Payload ID: 6681
  Gene Symbol: GGNBP2
  Gene Name: gametogenetin binding protein 2
  ENST ID: ENST00000633772
  CDS Start-End: 222-695

SEQ ID NO: 136325 - DNA, 2315 bp, Homo sapiens; identical to SEQ ID NO: 136320
  Payload ID: 6681
  Gene Symbol: GGNBP2
  Gene Name: gametogenetin binding protein 2
  ENST ID: ENST00000633758
  CDS Start-End: 293-499

SEQ ID NO: 136326 - DNA, 2083 bp, Homo sapiens
  Payload ID: 6682
  Gene Symbol: GABRA1
  Gene Name: gamma-aminobutyric acid (GABA) A receptor, alpha 1
  Uniprot ID: P14867
  ENST ID: ENST00000023897
  CDS Start-End: 469-1839
aacagaagatgccggagaaggggggggaaaagtagatgcggatttcgtcctgacttctaaaaattcctcctctccctctcccattttcctaatccgagaatgatggagctcgaggcaaaggaatgattccggaaatggagatatgattctcaaacctagaaatgatcggagtgatttattagttaaatattcttcgtccaggaacccagcacaattcagagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacag

SEQ ID NO: 136327 - DNA, 4686 bp, Homo sapiens
  Payload ID: 6682
  Gene Symbol: GABRA1
  Gene Name: gamma-aminobutyric acid (GABA) A receptor, alpha 1
  Uniprot ID: P14867
  ENST ID: ENST00000393943
  CDS Start-End: 784-2154
atatgtgtgggagtgtgtgtgtgagggagagaggcgagacgagtgctctccccacacgtgtaaccctgcatctcccagtttcagagcttgcgttcattcatatgcaggcagtggtttaatatttgatcaaaggtagaatagttgcactaaatagttgtatttttaatgggctcaccttaaaatcgggtgttcataaattgcaagtgtgaaaagactctaagtgcagtccgtatgtctctcaccctttctacccttccctcccccattgccgctccccccaaaaagagaagcttgcagcagattgtagaaggatttgagcctgcagctagagagaaggggattagggccagagtggtgcaagttaaattgtgctgcatataaaaaatgggcggattggtctccagatccagaggctggtaccaccttcctttctaaaataaaatctctctggcatgaagtcaccgcctatttcacatccggtttgccctgggacgtattactactgtcttggtaaagagaaatcttttgttgtatagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaa

SEQ ID NO: 136328 - DNA, 4285 bp, Homo sapiens
  Payload ID: 6682
  Gene Symbol: GABRA1
  Gene Name: gamma-aminobutyric acid (GABA) A receptor, alpha 1
  Uniprot ID: P14867
  ENST ID: ENST00000428797
  CDS Start-End: 356-1726
gggagagaggcgagacgagtgctctccccacacgtgtaaccctgcatctcccagtttcagagcttgcgttcattcatatgcaggcagtggtttaatatttgatcaaagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaatacttgactctcttttcatgtt

SEQ ID NO: 136329 - DNA, 4087 bp, Homo sapiens
  Payload ID: 6682
  Gene Symbol: GABRA1
  Gene Name: gamma-aminobutyric acid (GABA) A receptor, alpha 1
  Uniprot ID: P14867
  ENST ID: ENST00000437025
  CDS Start-End: 185-1555
gatacacagacagagctttgaacgtggcttttcctagctggagagacaggaatgttatagtcggggggggggggcggggggagacggggggagagagagagagagagaagaaggagagcgagcgagcgagcaagggagcgagcaggacaggagcctgatcccacagcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaa

SEQ ID NO: 136330 - DNA, 566 bp, Homo sapiens
  Payload ID: 6682
  Gene Symbol: GABRA1
  Gene Name: gamma-aminobutyric acid (GABA) A receptor, alpha 1
  ENST ID: ENST00000519621
  CDS Start-End: 63-566
gagagcgagcgagcgagcaagggagcgagcaggacaggagcctgatcccacagcagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatg

SEQ ID NO: 136331 - DNA, 591 bp, Homo sapiens
  Payload ID: 6682
  Gene Symbol: GABRA1
  Gene Name: gamma-aminobutyric acid (GABA) A receptor, alpha 1
  ENST ID: ENST00000522651
  CDS Start-End: 253-591
agcttaaaaattttaatgcacagttcactgtggaaactgaaatcttaaaagtccaaatatttagatgataaacaacaagaagagaataaaccaaactatattctaaatataaaacctagagataaacaactcacagtttttatgttgagcaatactgtcacctgaaagcgtttcagcttgtattcttttacaggagaataaggacactgatatatttctgaatggagaaatggaagggaaagtggagaatggatggtccaggtttccattgcttccaatgaggtgtcatatcccagtgagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtattt

SEQ ID NO: 136332 - DNA, 414 bp, Homo sapiens
  Payload ID: 6682
  Gene Symbol: GABRA1
  Gene Name: gamma-aminobutyric acid (GABA) A receptor, alpha 1
  ENST ID: ENST00000521339
  CDS Start-End: 142-414
ggaaggcacgctcttgtcctggctgcaaaattgcctgtttttccctttccagtggacgctggtgaaatgccctcttgtgtaggggtctctcccattctgaacacgaaaactcaacttagtctttgatatggatggcatgggatgctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatg

SEQ ID NO: 136333 - DNA, 411 bp, Homo sapiens
  Payload ID: 6682
  Gene Symbol: GABRA1
  Gene Name: gamma-aminobutyric acid (GABA) A receptor, alpha 1
  ENST ID: ENST00000635096
  CDS Start-End: 307-411
atatgtgtgggagtgtgtgtgtgagggagagaggcgagacgagtgctctccccacacgtctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaactt

SEQ ID NO: 136334 - DNA, 1070 bp, Homo sapiens
  Payload ID: 6682
  Gene Symbol: GABRA1
  Gene Name: gamma-aminobutyric acid (GABA) A receptor, alpha 1
  ENST ID: ENST00000634335
  CDS Start-End: 215-1070
atatttctgaatggagaaatggaagggaaagtggagaatggatggtccaggtttccattgcttccaatgaggtgtcatatcccagtgaggtcatttcctgacttcaaagcattcatctaaactgcctcagtcagccctggtggttataacctgatgtttcttgctagagacattgatctctacttattctacttttcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttg

SEQ ID NO: 136335 - DNA, 2770 bp, Homo sapiens
  Payload ID: 6683
  Gene Symbol: GABRA2
  Gene Name: gamma-aminobutyric acid (GABA) A receptor, alpha 2
  Uniprot ID: P47869
  ENST ID: ENST00000356504
  CDS Start-End: 674-2029
aaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagagtaattgcaaaagtgggctgcctgcccctagcttttcccgctgtggttgcggaggtggtcttggttgagggggttgtggcgtgaagtacccatctctcctctcctctcctttcctcccctcccctccaacccattccctttccagctgctatgccagtttaaagtccagggtgttattattacgtgtgcgcaaaacagtgtttgctgacgatgaggctgggggacgttcctggcagagagaagtctgattacttggtcatcttgctgttaaagaaagaaagaaagaaaaaaagaaagaaagaaacagaaaggaaaagggtgggggtgggggtccataaaaaagaaatcgtctctcaatcatcaagtcctacacagagtccaggaagtaatctccatagctttaacacgaatccctaactaaaaggatattctttggggttacttggatagtgaaactgaaggcaattttaagtgtattttgtttttcattccatggctttgtaaagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaatt

SEQ ID NO: 136336 - DNA, 2525 bp, Homo sapiens
  Payload ID: 6683
  Gene Symbol: GABRA2
  Gene Name: gamma-aminobutyric acid (GABA) A receptor, alpha 2
  Uniprot ID: P47869
  ENST ID: ENST00000381620
  CDS Start-End: 205-1560
cctagcgctcctctccggcttccaccagcccatcgctccacgctctcttggctgctgcagtctcggtctctctctctctctctctctctctctctctctctctctctctctctctctctctctctcccaagtttcctatctcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctg

SEQ ID NO: 136337 - DNA, 3401 bp, Homo sapiens
  Payload ID: 6683
  Gene Symbol: GABRA2
  Gene Name: gamma-aminobutyric acid (GABA) A receptor, alpha 2
  Uniprot ID: P47869
  ENST ID: ENST00000514090
  CDS Start-End: 182-1537
tcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagagtaattgcaaaaagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctgtttactgcaaattctgccttaaggcttcttttcaagactcagaagccactaattataaaggaaagggcagttaattggcacatttttctcttgtgaaagcagttctttcagataagaattaatgtaaatctgcttttgtaaattgcaactttaaatttcgctgactcaaatttacaacagctttgtataccagaagaggttttggtaagggttgaacatttttacactgcaactttaaaacatcaccaatagattgtggattatttcacgtgcacaaacatacacacacacacacacacacacacacatacacagctaaattagaaaacacaattttaaattttatataattactagttattaatgggtaaaattcatttttcttttaatatcttaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgctttgcatgcttgtataaaaccaaggtcacaaatgcaacttattaacggaatttgccaagaagacagccttgacattaaaaattccctcacaagaggtaatccataatccttaataaaataaaattgttacatgagccaataaa

SEQ ID NO: 136338 - DNA, 1017 bp, Homo sapiens
  Payload ID: 6683
  Gene Symbol: GABRA2
  Gene Name: gamma-aminobutyric acid (GABA) A receptor, alpha 2
  ENST ID: ENST00000513005
  CDS Start-End: 8-208
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctgagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 136339 - DNA, 3411 bp, Homo sapiens
  Payload ID: 6683
  Gene Symbol: GABRA2
  Gene Name: gamma-aminobutyric acid (GABA) A receptor, alpha 2
  Uniprot ID: P47869
  ENST ID: ENST00000510861
  CDS Start-End: 175-1530
gagaacaagctttagagatgataaaagcacagtatcttggcaaccttttgtgttgggttatttttaaaaaatggataatattgtgctctagttctcatttattcagctacttgctgagtgatagcaacattacaactacagaacctgtatgtcatcttgacattagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctgtttactgcaaattctgccttaaggcttcttttcaagactcagaagccactaattataaaggaaagggcagttaattggcacatttttctcttgtgaaagcagttctttcagataagaattaatgtaaatctgcttttgtaaattgcaactttaaatttcgctgactcaaatttacaacagctttgtataccagaagaggttttggtaagggttgaacatttttacactgcaactttaaaacatcaccaatagattgtggattatttcacgtgcacaaacatacacacacacacacacacacacacacatacacagctaaattagaaaacacaattttaaattttatataattactagttattaatgggtaaaattcatttttcttttaatatcttaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgctttgcatgcttgtataaaaccaaggtcacaaatgcaacttattaacggaatttgccaagaagacagccttgacattaaaaattccctcacaagaggtaatccataatccttaataaaataaaattgttacatgagccaataaatgtatttctttaattcc

SEQ ID NO: 136340 - DNA, 1155 bp, Homo sapiens
  Payload ID: 6683
  Gene Symbol: GABRA2
  Gene Name: gamma-aminobutyric acid (GABA) A receptor, alpha 2
  ENST ID: ENST00000510233
  CDS Start-End: 8-487
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 136341 - DNA, 5812 bp, Homo sapiens
  Payload ID: 6683
  Gene Symbol: GABRA2
  Gene Name: gamma-aminobutyric acid (GABA) A receptor, alpha 2
  ENST ID: ENST00000507460
  CDS Start-End: 334-555
atttgcaactacaataaaatccaggacacctgctcggcagcacgttagcctggctcttttatagtcttcaactttgctcactgtgattaccgctgcctgcctggctggtgtttgctgccggagcctcacgcgccttctcttattgtgatcctcggctccagagcagctgtcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagtttccagagtggaatctccagtctgtgtaacatagccttcaagagccagaacaaagggacccaaactcaaatgctctccatgggcagaacaaataaaggaatgagtggagcataatggagattgaagaactggagagcacatttcttgtatgaagggggttgagttttatctgatcattgccacataagtatttaaaatcagagttgccagatattccaattatttttcaaaagttgttgaagatctccatttttatagaaagttttcttcagtcttaaaggtcaaccaattttcatttaaatcaaactaaacaaaatctgtgcttcccaaacaaatcacacttgagtattagtttgcagcctctggccctaaaccaagacttctcataaagggtatgaaaaaaccagtcggaaaacttgttaagtgcaaatttaacaaatcttcaaagactcattcagatttggtttggtcccagaactatatttcaacaaatgttcttgattctgatgcacatggtccaaacactggactgagtcatctgttttcaaggttctggttaaaaatgatggtttctttcttctttctctcatagtactttatttgaactcttttaagttaaagggaaaaagaaatgtgtatggtaagattggtctgttaccagatgagtctagctagcattttcctcaaaacctcaaagagaggcctctgtcccccattgttctgaggtggctgtcagtgttacaaggtcagagtcctacttttgtttagtgattggattagtcagaattaactggcttatgtttcagtaataactatccagttttatctctcgatcatgtatcttgctcacgatccaaccttgtccactgaggttggatggcatgtaggaatgggctctcttttatgtcttcctcacttagggtttcggattgatggacttccaccacctaaaacattgctagccactgtgtccaggggaaagatgtggctaggtgtacactgtcatttaaagcttctgcccagatgtgacacaatgtccctctgcccacagtccattgttcaaaggaaaccatatacacatgtttaacttcaaggtggcagggaagtgcaaccctaccatttactcagaagtggaagaactagcaatattttgcaagtaacttaataactaccacacttggcaagtagaacccatttctcagggtgcaagtcatcttccatagtgactgattatacaaactgtttggtgacacaggtcatatctcatttcaagatgtataattctgcaactttgttttgtctgtagcatgcatagaatgtttatgaagttaattattatgaagatatgatattaataaccatgcttttttggatatagtcaactttatgtaccttctcttttcttggtgttagaaggcagtgctgtatgccctttttccaaagctcccaggaataaagaggtttgccatttgtgctgtgaaggcatagttccagttgaagatatttaaaaagagatactctttgaagtgttagtctgaaatttcaacctccgtgacagtaattgccagggagaatggagttagataggtgaggaagagaccatgtgtggtttgctactgtgtccttagtgcttggcacagtatgtagaattcaccatttgtcaattgattatgtgaatccaacactcatatatgcaaaaacagacatatctgtgctttggagagctacttattttgggttcttagaaatgtttttgacattcaacaatcaatttttttctatatattttagtggtttagacttctgacattgctaacaacgagtcatccttctcagaaacaatgttgattgatagatgggttaaattggtctgctgaaccttaaattcagtagcacataaaattagaaccattgggttgaacctggatttaatatagtgaaatggactaattcagtagcccctgctgttactgcttttcagaccatctgagcagtgatcatgaacaaaggctctatggcttcagtcatctgtaatgcatacaacactgccttctaaccccacaacaaaagctttggaagagccactagatgcacatgatagagacaaaaacaagaactacaaaaatgtattttaaaagcctgaaaagcataagcctaaaatgtctctgtattttgagattttgcaaaactattgttagttttataccaaccgtttaaagtttttcagttgtcttgcagaggctgttaatgaaaagttataagataatggaatcatactaaattataatttctaacaggttctgagattgaggtgccatgctaagcactttacatatcatttaatactcattataactcccatgagatagataaattgatgacccctaccttagaagcaaggaaatgagagccgcagaccaattacttgccttttgtcacctaattattttgtgatggcatggatattctatccaatataattttctcaagagcctttctccagagtctcatcaatcaggaattaagcaccctcaaatcaaacaaaggtggtatcaatgagtatatgtatgctttggaggaggagctcactatttgttacatttgtgtaatcattagcatctggataagtatctctggaaggggaaggatggtgcgcagtttcattcttttatttgtttaggtgttcttattattgcatttcttggtcatcctgagtttgacgtatatccagacttgaatacaggtttagacatgaaggatcagaaaggacagtgcagtgtttagcagaaaatctattagggtgttgtgaattaaagccagaatctgttactctcactgctgattttactcccttactgtgtgaatcagagcttttggtattattatgctggagaatagctaatgagaaggagataagaagaccatgtagtctagatagataatctcagcatttcttggtacaaagtacattggtacttgagttatttgtaaaattagtaatacaatgatgcaattgttcatataaatttcaatcatgttaagcttattataagtgatattgaagtaatatgatacatgaagaagggatgagtatatgaaaggcaaatagatgaaggcatattaaatgcaagaaccctctttccagatgcattgagttacaactgcttcatttccctttgttcccatttgacccatgtacatcttatgagacacaatatagtgtactttggaaaagatcaggctttggagcttgaaaaaccagggtttgtattctggtttgagcatgttcttaccatgtgctttttgtatacatgaattgccttctctaaacctcagtttcttcatcagtaaaataagtataaaataactaacatttatagcaaggttacaaagagtaatgaaattatttgtaatgttcctgtaaaagtacccagcatatgttgggtgttcattagtggccaacttcccatgtgccttttgatttttgcgaacatgtcataatgtggagatttgttcacaatttaggaaataatgagtgaaaatgagagaacatctaaaaataggacatgagatagttatttttactaagagagttcatggagtttgatagtctttatttaactgtgtatcctagggttacatgtgattaaatttttcctttgtgggatgccctttaagtagaagtttattgcaaaattctccatagaatgtttaaatttcatggtatttcttgtcatacactagaattaaatgagaaggaatagttggattttgagattacatctatggaagtacagaaccaaacaggagaataaggtgtttctgagaaaacctgagcagtcaaataaatgatagcttaacttcatctggcttttctttagaaatttagacttccataaatatgttgtatttcccttgcataaatattagccattagtgatctaattacctgttagatttctaatcatgattacttatgatttcttcaaaacttaaaaaaggtaaccttttaaaatgattgaaagtgttatgcaatagacaatttttaaaacatttactgaaatgagtaggagatagaattctaggctatccccaaatttcttgtcacatgttttacatgccctgtatgatttctgtgactgtgactgtgatttcagtctgatgattagtttttgttatatggcacagttgactttaagaaagggacattatccgagtgggtctgacctaatcacatgagccttttaaatctaaatcaagagatcagagacagaaaagtccaggatatttaaaacatgagggagattcttcattgctggtagggggccacatggcaaggaacacaacagcctctaggagatgagacttgacagccagcagggaaaatgggaatcttaattctacagctgcaaggaactagatttggacaacaatctgaaagagcttagaagctgattcttccccagaggctccagaaaggagcacagcacacccataccttgatttcagccatgtgagaatctgagcagagaaccaagacatagcatgctggacttctgacctacagaactatgtgctaataaatgggtattgtcttacattgttaagtttgtaataatttgttaaacaatagaaaactagcatatctactgttactaattttttaaaatacatttttcagtgtttaacctgtgctaggcatagtgtactttacacctaccatctcatttaattatttcaaagtactgtaagataggcattataagccacatttaacagataagaatatcgaagcacatataagttaagtaatatgcatagggtcacaaattattagtgtataactctgaattgaatttagatctctttgattccaaggcttgggatcttacatgcccctttattaggtaggaatagatacttcatgaagatgataacatgccatctacagaatacgatatggcattgatgtgacactttacctacaaaatatcttatttctgagtcttccgcaagagaaaaagcaattttatttttatgggacaagattggatgttacatttttaatcaattacatgtaagtgtattctacctttaaaattgctatggaaaagtttaattatttccaacaggatttataactatcagttatacctcaaagttgttattaactgaataaaactacacattccaaaatgattaactcttaaagcgcattattggtacattcataatgtttaattttatttttatcatccttgctcatattgaataaatgccttttaaaacca

SEQ ID NO: 136342 - DNA, 2366 bp, Homo sapiens
  Payload ID: 6683
  Gene Symbol: GABRA2
  Gene Name: gamma-aminobutyric acid (GABA) A receptor, alpha 2
  ENST ID: ENST00000515082
  CDS Start-End: 154-1257
aagcggcctcggggagcagcccgaggctgcgcgtgggctccgctcctccggcgaggtgtgggcgaggggagcggcgctccgagcgcacccaggcgcccgacgccgcccgggtctgcgccgctgctagtgccaggcgggcgacgagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaaggtaagtgagagcttccgtgttatcattattaagaaaataccctaatgaattccgcttgtaacagatatgtttctaaaaactgacattaaagacatccatatatatatgaatttgaatcatatcaatttcttttaaagtgttcttgcctgaaatcctttaggagttcttgtagtactaatacttccattaaaaccactccgtagcatctgttgagctgtatgtgtcaggcactgtgctaagtgttttacatatgctctctcacataatctttatagcatccttatgactagactgccttcttattcttatttttactcatgaagaatctgaagcagtaaagttattttcttgcccaagcttacacaacttgttagtaagtatacttgaactccgatctacctgtctgactgttaagttcatggttttaacaccacactgcattattataaagagattagaaaaagaaaatgggcattaattttacttattatagaattccaggctctatcaatgaattgaatcctcttcacctgttccagtctctgctgattgattgtaaaagcccggatagcatttttttaaaatctttcccatgttgtatggaataaatatgtcggtgctggaatgcttaggaattttaaattgttcatatggtctaaaagggaaaagttatttgtttttaagattaacttcttttgagattattgctgtccatatttaggtttcaagtactgaatctaatgggagatttgtgcattgatataacagctgtttcctttcatactctgtagattatgtatctgcctaagaggaggctttgaatgtatcataatcatctatattcttaataatggtaaaaagttgtattcagaggatatctttaacattgtatcaacctaaatgcttcttttattaaatttggattaacatacttgcagatttgatttctttttcagttatttgaatatattttttcatttctatgaccatgttacagtttaaatatacaagcagtaaatgttatagtttaaaagtcttggtctttttccttaattttgtaagccatagaaattttaataagactgattatttatttcattttataagttgtgttttccctactaacggagccaacaaataaatattaaaaggaa

SEQ ID NO: 136343 - DNA, 582 bp, Homo sapiens
  Payload ID: 6683
  Gene Symbol: GABRA2
  Gene Name: gamma-aminobutyric acid (GABA) A receptor, alpha 2
  ENST ID: ENST00000506961
  CDS Start-End: 171-582
gtcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagaagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcata

SEQ ID NO: 136344 - DNA, 596 bp, Homo sapiens
  Payload ID: 6683
  Gene Symbol: GABRA2
  Gene Name: gamma-aminobutyric acid (GABA) A receptor, alpha 2
  ENST ID: ENST00000503806
  CDS Start-End: 142-596
agcacttgatcggaacccggctgcctctaagacttggtcttgggcaaccgtgggtgggcaggaagggaaattatttattttattttgttaaggggagtgaagaaaagaagacgtgaggaccgcagttcactagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgg

SEQ ID NO: 136345 - DNA, 605 bp, Homo sapiens
  Payload ID: 6683
  Gene Symbol: GABRA2
  Gene Name: gamma-aminobutyric acid (GABA) A receptor, alpha 2
  ENST ID: ENST00000514236
  CDS Start-End: 1-171
tccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggtgagtgaatacacactttgcagtacagcacattatgtttcatagcatactttcaaaaacattatctctcttgatcctcaaactaattatttgtagtaggtggggcggggagtattgtttttgccttataggtgaagaagtaggctcagagtggtaacatagtgctacactgttaataagggatataaggaaagaaaagtactcaaatattcttaaaacacacttagtcttctttctgttaaatcatactgctgttcaacatttgtctgtactatatttacacaaggagaattttcttagaagttttaatttatagtctcactaccatatttctaggctttctatatttttctgttgtttttagatgaagagtgatgatcttaaaactttaagttagaaacaggtagaaagggagggaggaagagagacctcattcactttt

SEQ ID NO: 136346 - DNA, 574 bp, Homo sapiens
  Payload ID: 6683
  Gene Symbol: GABRA2
  Gene Name: gamma-aminobutyric acid (GABA) A receptor, alpha 2
  ENST ID: ENST00000514193
  CDS Start-End: 65-265
tcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcaga

SEQ ID NO: 136347 - DNA, 1562 bp, Homo sapiens
  Payload ID: 6683
  Gene Symbol: GABRA2
  Gene Name: gamma-aminobutyric acid (GABA) A receptor, alpha 2
  ENST ID: ENST00000507069
  CDS Start-End: 8-1543
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 136348 - DNA, 2588 bp, Homo sapiens
  Payload ID: 6683
  Gene Symbol: GABRA2
  Gene Name: gamma-aminobutyric acid (GABA) A receptor, alpha 2
  ENST ID: ENST00000540012
  CDS Start-End: 568-1851
atcgttttccccctcctcctcttcctcctcctcctcttcctcctcctccgcccatcaccgccactacgaacgccttcgcctccttctacacctcgcgccgccgccgcggctcctagcgctcctctccggcttccaccagcccatcgctccacgctctcttggctgctgcagtctcggtctctctctctctctctctctctctctctctctctctctctctctctctctctctctctcccaagtttcctatctcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactacctt

SEQ ID NO: 136349 - DNA, 2273 bp, Homo sapiens
  Payload ID: 6683
  Gene Symbol: GABRA2
  Gene Name: gamma-aminobutyric acid (GABA) A receptor, alpha 2
  ENST ID: ENST00000630416
  CDS Start-End: 65-265
tcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaatt

SEQ ID NO: 136350 - DNA, 3712 bp, Homo sapiens
  Payload ID: 6684
  Gene Symbol: GABRA3
  Gene Name: gamma-aminobutyric acid (GABA) A receptor, alpha 3
  Uniprot ID: P34903
  ENST ID: ENST00000370314
  CDS Start-End: 240-1718
agagagagagagagagagagagagagagagagcgagagagcgtgagcgcgcgcaagctagcgagcaaaccagagagacagaccgagagagggaccaggagagagacccagagagagaagaagaagccagaagccgagctctgtcagggctcaacctccaacttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccccttcgcgtatttcaggattctcctttttacccctctaccaagctgtgaccctcaattcatatttatgaatctctacgcaaaaaataactacagaaaaattacttgtccctccaatattgcccagtataaccccatcaaagccaaacactgccatttgtccagttgctcatcttagtctgccaatctcccctagctgagggcactgcatgtattttattgcactctgcccgctgcaaaaagaacaagagattctactctccatagtggaagccttggctgtttgagaggcccagaacaaggagaattgttgactcccatctagatcagatgactctaacttactaggcagccaggttaggctaggccatgtgatcctgcgtgccacctcccctgccttcagcaaggcctactaggcataagtactgatagcaaaggtgggagccagttctacacccccaacccatttattggtttggaaattagtggggacaattggtactaaccaccgtctaccatgtatggccaaaataaatagaactagctctgccagcctggcaccaagatggctggtgccctgccatgtccagcccctcgggaaaatagtcccctccttggtacatctctcctccagaaaatcttcttcccccactgcctttggcacccttgtagccaactgagcactacttaatttggactcattaccacctgtaaacttttcaggaaaaaatgatcaagcattttttatttatatcgaaaagttgcaaatagaaacaaagtgatctagatttaaaaaaaacatttttttaaaatatgggagagatacaaaagtcacctccctgccaaggcaactagcctatactggattgggtaagaggtttggagtggatggtagttgaggattgaagtctggctcaaaagagaaggctactggcagatgaaagtcaaattcttccttccatacactccacattccacaccctggcccaggcacttttctcccaccatatcgggaacctccggtcctctgttgatgccgattctatgaggggtgaattggaaattcatacaaataaatatctctagtcaatattgagtcaactagatcattaactttattgccaattttataatatattatttagaggccatttgttcttaatcttaatgtgagtaaaagacacaggcataaatacgcaatttttataaggtagataaactgaatcccagaagtttgaatgatttgcctaggctccttacaagtgtctttaataaagagctatcgtgcgcccctttccaaaggccaaaataaaggactgagaagccaggtccaccgtgacctcagaatcagcacaatctcagcgggccttctgggtcactagtggaacttggttgggcaccaaaaaggtttttagaaagtcacaatgtgtcacccaagaagatcacttttaatagtctcagcccaagagaatgagactgtttatgatggcagccccagccactttggctctgaatacctgcactagtccagagtatcctagaagcccagggtaaagccacagagggcaccacaagcagattctccctgcccaccggctgaacaaagctcctaaggggtgtatcattagctgctggttgccttttcatccatcctttccccgtcccctgcttccttgccattgctgggataatgcatgcccgtcccattattcctaagactgtgtctgtaggtaaattcatgactagaagagtgtagtcttgtggatatgtggggatatggggggtgggagggcggggctgttaatggttgtcttaaggaacttagaatggaagcctgatctttgcctctctgtagaaattgtgtttccaaatgctttggtgcaatgtttagctgctgtttattaaaccctttctgaattgta

SEQ ID NO: 136351 - DNA, 1697 bp, Homo sapiens
  Payload ID: 6684
  Gene Symbol: GABRA3
  Gene Name: gamma-aminobutyric acid (GABA) A receptor, alpha 3
  Uniprot ID: P34903
  ENST ID: ENST00000535043
  CDS Start-End: 219-1697
agtgccgcttcatcacgcagcatggttgtctgggaatgtgccgtgggatctccatttgcattaattccttcagctcctggaccaaagccatttttaaaaattcatgttctgtgtatcacataacacagtatttgtgattgcacctgtactatgtccatttatttctgcatcatggctacttcctcctgtttcgtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtag

SEQ ID NO: 136352 - DNA, 11973 bp, Homo sapiens
  Payload ID: 6685
  Gene Symbol: GABRA4
  Gene Name: gamma-aminobutyric acid (GABA) A receptor, alpha 4
  Uniprot ID: P48169
  ENST ID: ENST00000264318
  CDS Start-End: 984-2648
agtcaacctctggaagtaagtcaactccattctgaaaaagaagagtgtcgcaagaagtgaaagtgattttgaccagaggtcgcttgtctccacctctcccctcctctccagaaaaggatggagcagcaaagcggagggtgtgcgcgtgtctggtggaggcgggtaaagaaatggggtgtctttaaagcaatagcttagcaaatactgggactagagtgcggctcgagtccacttcccaatagtttggcgagagtccgccgggtgagctgcaacccctgttaccaggaagaatctttctgctttcattgctctccctaccgccccccataacacctgaatgggagggtctcaaaggtggtttgagcccggacttgatcccctctcctcaccaccgctaccacccgacgcccagcagtccccgtcacccgccctttctccacctccaaccttgactctgggtacaaacaggtcctcgcacaacctgatgacagaggagcttcattggttagatccaaatcccagcggaagggagggggccaggaggtaggaggacgaacactgctgtgggcggggagcccacttggggtcgggggctgcgaagccggaggaggggcgagagaccccgttcctcatccccggagttacagtcggaacaaacttgccgagtcttgcagcgcaagcgcgcggatacgaaccccagaaccttcagcgcgcgggcacgaaagggtgtggagcggtatacatagctctacatacacattgagcgctgagcgagaaaggagggggcgaggaaggcaggttccgcctcccctggccccgtgcacacacacgcccaccgcggctcgggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttccatttaaagatataagccagttattgggagagttaattaattcctgagtgaaaaagtgaactatgttttttttcagaaaaattattttaaaagaactcagcattcagttagatagaatacacaccatcctggaaagttgggataagagaaatagagctattagagacaagtggcgcatattttttcattgatatttgaaaacagactatgacattttaaaaatctgccctatgagtatcaacctgccaccctaaatttcccagtggcactacccttaaccagaattgtttattagatgtcatatgcagtgacctttggtgatcttcttaggaacttcaagaaaaggaattttcctgttaaattaaacattggcaaaaggaaatggaatagtataaacactgatcaatagagtaaaatatctgctgcataaaaaactaagacaaagaccagaggaaatatcttccctttcttatgttggctaaacagtacttaacagttgacttgaaattttgttctctgagccaaagtttaactcattgtatgaattctttttcatggtagttcattcagttatgtgtttatttactacatagttattcagagcctactgtgttccaggaactatgctagaaactgtctctctaggaaagctcttgcacctttatctacaatattacttaaaaagtagaacagtcaatgcatgccaaagaaccataaactagcagaggacattgcattctttagtgaaggacatttatttagagtctgacaacatattcaaaatatttttcagcctctactgatagtggataacaaatatatttgttcacataaccactttgatgtcagtacaacttcagcaattggttttcaaaatagatgagaatatggtacagattgttctataagtgaaaagcattatgtacttgaaagtaaaaatcagggcaatataagacttaatagattaactgtcgcaaatttgatcagagtcacagagtagaatttgatcagaatcacagaatcatcagacataggaactgagcacaggctttttcaggtgctttccccaagatagatctagatattagctagtgaaatgctaaattttgaagagttttgtgtccgtagttctgtaattctgggcagtcatcatgttggtttttttgggagtttttttaaggtttaataactaaggggaatattttaaaattaagagagcagcaaatgaaaggagtaaagaaaaaaatagctgtcgggtaggatgccactgactctgctatgtgatttatcagggttttcatctactgacttctttctcattaggtaggcttaacaacttacttgagaattttgcaactgtctatgcagctgaatctaagtatggttttttgtcatattgcctctagattttcttctgtgcttctctctatctgctctggaatggatgagtgaatgtgttctgggtgttttagggaacatattgatagaaatgaccaccttgcagacaaaatctctctctctctttttgtttttatagaaaagaagtgatagtagttaattggcatcgatttttcagatattgcactaccttataatggttgtttttgatacctgaaaattgtgcaaatgccaaatattaattgtaagtcatatctgagaaatcattcttggctgtctttctaggtattccatagaatcaacacattttaaggctgaaagatactgtcgaaatcacccagtcccaaccccccaatttaaaattgattctagtaaaattaggtccagtaacacctgtatatatgtatatatttaataaagagtacttgtacaaaaaagcttatcataaattatttcatgaatgtgaatagatttctggccttgaggacgatgtttggaaatatggttggaagcacaattcattcgctactagttattcagagcgtactttgttccaggaactatgctggaaactgatagttcactattctgatgaaaaggctggttttgttgttgttgttgttgttgttgttgttgtttttggtgaggaactcttactctttgctaatctattggcctatcttaagaaataattatttggttattcattggcttcctttaaaaaaaagtgttcttctacaaatcttacagagtgtaaagagataaaaagaaatgattttttttcttacctttacatatgaaggtttaaaaatacatcatgtggccaaagaatgagaaaggacagaattaaccaaggattcttaattgttaatttgaagaacacattaaccagaaagcttaaacattattattaaaataaattatttcatttgcacacaatgataataatgatgataataataataataataataataataataataataataataatatgttgtttgctttccttaactgaatttcatcaaattcattcagtgatttttattttggtcattatttctatcttcccaataacccagaggtacatcaagtaaaaacacttttgcaaagagccagtcacttttccctcttagaaaatctcagaagaatgattaggggcacccaaagttctggttatctatgaataataatgaataattttggctgagaatggtacctttatataactcttttaaagatgaaattcagaataattttattcaggacctagtatctgcagtccatgttggccactaactgctacataattactttcaatttcctccaggcatgactaggtataaacatatatttacatgattaatccacattttaaaatgacttgcacttgtgcatatacatagtactttgaataatgtatattttaaattggacctcacaaatcttgtattaaagtaggtagagagtagagtcacactttttttgatgaaatgagtcacagagaagttacatgacaaagataaaatcacagggttggaaagaactttgaaaggtcatttttcaataatctcaccttaaaagtgaccccttttcaaacaaagcataaacaatttatttgtggcttattttacccatgagctggccaatacttcctggcctagaaaaatatctccactctccccattcctgttcttaatggtcttctcttctcaatttgtaaatattctccagtaaaagacaccaggtgtggagatgggtcacttaatttcaagttctgagtgtcttgtggttttaaacaagtctcttaacctctctaagactgattcctcatttataacagggaggaggtggattatgtaatatctaagagcttttcagttttaatactctctgattctcatagtaaatacaagcatactcttgtaagaaaaacactgaatactttgaaccacaaataagtgtttatggacaaaaatttagttctactgcttgattactttaagttcattgcttgcttcaaactaaggtttccctaccttcaaaaatatatataacatctctccatttagataaagtatattcttccccagggaagactgtattctttaaagacagtagaatattggctatttctcttttctgggatttcctgggcttttattcactaaatgggctcctgcccagtttgggtactgtgctgatttttagatatacagagataaaaatagcccctttccttgcaggtagtcacagtccggaagagatgatagatgcatagacaaaaaattatgggatgtaactaatgcttcagtagaatacagcagggccaaaactagagtgatactcatctcaggcacaaatatatatggggacatcaaaacttcaataatcaagatacctaatatttaagtgaatatttttaaaactcaaaattaatgcaaaagatttatgatgaacagaatatacaaattttaaataaattaatagaatcagtagtaataatattttcttctgcctcaggctccaaaattgctcagcatagcactgatctagatagaggtggataaaagatccacataacttaattacattgttgaaggagaggaacaagagtgatagcagagaaggtttcacagatataatcttaagctaaattttatagaatgatttggagttcttatagcctccattcccacttccacaaacaaacaaaaaaatgaaagcgcaattttatcagcacctgaggcaggagaagagatgaggatgtggaaagtcaaggggaactcttactacaaattcttagttctgtgtttggaggtaagggtgaatgcagggaagtgagagttgttgatgttggaaagacctaaagagcctggattaggaagagttttgtgtaaattactgaaggaatggaatttgatcaggattagtggcaatttattaaaaatcttgaagaataatacgatgaaaactaacatccttatttttctgttttagagaaagcacctgattattgtgtgaactatggtttggagggccacaaatctagaggtagtggaacagttgagatctcttattttttctttcctgtcttaaactttgccttctattccttttttctttttttgaccgcaatgacttcattgtcatttgtaaaagtgatacatgactgttaaagatagacattgtagaaacttaaaaacaatctcaaaattctaccacccagaaatcagaaatattttgtatttggatatgtttgtctagaagagtagattgcttgattaaaagacagagttttataaatgtagaagccaatatgacatacatgctgccattaaataataaaaaattaaattgacttttatctcaagataagattaaaattggagggtaaaactgaagaaattgttgaaatttggatggtgcttctttaaagcaagagatttagagagtcagagctttttatcccaggtttcaatctttatttcaggaaaattttctgcaattttgtctaagttaattttttttttttaagaaatgccaattatgtcaaatcccttttgtctctatacaatagtccccaactgttttggcaacaggcacgggtgagggtgggggaatggttttcagatgaaattgttccatctcagatcatcaggcattagtcgattctcataaggagcggacaaccttgcatgccctcctatgagaatctaatgccgccgctaatctgacaggaggcagagctcaggcgataatgctcaatgggtgccactcacctcctgttgtgctgcccaattcctaacaggtcatggataagtactggtcagtggcccaggggttggggaccactgctctgtaactatttacagtattctttgtaactactttggtatctttaaaattttctttaacttttgtcaaccataaccctagtgagttttcagttgtgattattctattttgtaacttccaatgtacttttcaacttcataatggttaattttgttttccattgctttcttggtcactgtcatttcatttttcttctctttctctatttttaccattgctttattgaaatatcttctttgagcttctcatgtttctctattaatgagatcatgtctataatattttttgagactacagagacctatttatataaactcttcctctatttcttgaaaaagtttttatctggcgtgagcttcatctgctttttcattgaggttttatctcccttgcctatttttggggctggtttctttctattaatcactgagcagagccagctatttactgaactacagtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgttaaaaaaaaaaagaaatacccatgcgtaatataaaagaaattttgaataaaatgttatcctttccttttactagagacaaacatctccacttcaaaatggaaaaatggaactatgcaaaggaaatttacgatattcaagagtatgatattatcactgaaccgattaatttaattgaaaatactaacctgcaaaaaagaattacacaaatgtatttgaaatgtcatcagatacctcaagctatgacagagttgattatgttacacaagtagtaaaggataaattaaatatattctatattaacactaagatttaaaactaattatagtcttctttaatttttctactgtatacatttcatctagttttcagtaaaacaaacttttcattacttttacttatcccatgcaaatctagttgctataagatataacctaatttggaaatacctccctgtaatacattggaattttggtgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgtttaatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaa

SEQ ID NO: 136353 - DNA, 1623 bp, Homo sapiens
  Payload ID: 6685
  Gene Symbol: GABRA4
  Gene Name: gamma-aminobutyric acid (GABA) A receptor, alpha 4
  ENST ID: ENST00000511523
  CDS Start-End: 82-192
ctgccctctcctcgcaccctgctcagggcatctgaagagcctggaaacgtgaacaggcttgaagtatggcatgttgcaaagatggtttctgccaagaagtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaa

SEQ ID NO: 136354 - DNA, 871 bp, Homo sapiens
  Payload ID: 6685
  Gene Symbol: GABRA4
  Gene Name: gamma-aminobutyric acid (GABA) A receptor, alpha 4
  ENST ID: ENST00000502874
  CDS Start-End: 117-227
gtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttg

SEQ ID NO: 136355 - DNA, 1776 bp, Homo sapiens
  Payload ID: 6685
  Gene Symbol: GABRA4
  Gene Name: gamma-aminobutyric acid (GABA) A receptor, alpha 4
  ENST ID: ENST00000508560
  CDS Start-End: 82-192
ctgccctctcctcgcaccctgctcagggcatctgaagagcctggaaacgtgaacaggcttgaagtatggcatgttgcaaagatggtttctgccaagaagtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaa

SEQ ID NO: 136356 - DNA, 3251 bp, Homo sapiens
  Payload ID: 6686
  Gene Symbol: GABRA5
  Gene Name: gamma-aminobutyric acid (GABA) A receptor, alpha 5
  Uniprot ID: P31644
  ENST ID: ENST00000335625
  CDS Start-End: 889-2277
aggaactgcaccactaggacggacgacacaccgacgtaatgaccatagtaagaccccatgtacgtggctaatgaggcagtgacccgacgtggctcggaagccctgctggggagatcccgccccgtcaccccagaggcgctctccgacctgcagcccccagggctcctggccctttcccgtttgccactgcggcttgttgtcaagaaatggaacttcagaaaacccccagatatacactgcgttaggtaaggatttcattctaatcgagtccaatgtgaccctggctttccctcccgtagttatgcattcctgtctatgagtgagatgaaaagaatgtccacaggccagcttctttcagaagcgcctaagagatgcgcatgtaaggggtgccatggagcacccgggaaggacccaggcctgggcagggaggcgttggggccggctctagggagcaaagctgtcggagtccaggcctctatcacccgactgctgacactgccctcccatccctgctctacaagcgggcggtggtgactacacgaggcgccgaagatgctgttgagggccctggagaaacttcagcagaacagggcctctccccttgcaggccgagccgggggccctgcgccctccccctccgcccagctcggccaagggcgcatttgctgagcgtctggcggcctctaccggagcacctctgcagagggccgatcctccagcccagagacgacatgtggcgctcgggcgagtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagccgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaattaggaaagtactgcatgatcttacacgaagaaatagaataggcaaacttttatgcaggcagattaataacagaaatacatcatatgttagatacacaaaatatttccctgaggaaaaaaaatcaactgcttaaattttttgggaagaaaaagaaacatttcttaccccacaccacccactacctgaacaatagccaagaaaggaaaggagatgttaaaacaaacagtgttttgatgacattctcagcacttggcccatgtgatcgctgtctctgaaacactgaccacctctccctacagccagcgtgtagtgcttcagtggtgagaaattgtaattgagttattttccattttatttccttgtatgtatttcatgactggacttactgctctgtcagcttttgtatatgaatcttaaatgttcattaaaaaataaaaaatgaactgatcttgtgg

SEQ ID NO: 136357 - DNA, 2183 bp, Homo sapiens
  Payload ID: 6686
  Gene Symbol: GABRA5
  Gene Name: gamma-aminobutyric acid (GABA) A receptor, alpha 5
  Uniprot ID: P31644
  ENST ID: ENST00000355395
  CDS Start-End: 276-1664
gaagatgctgttgagggccctggagaaacttcagcagaacagggcctctccccttgcaggccgagccgggggccctgcgccctccccctccgcccagctcggccaagggcgcatttgctgagcgtctggcggcctctaccggagcacctctgcagagggccgatcctccagcccagagacgacatgtggcgctcgggcgagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagccgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaat

SEQ ID NO: 136358 - DNA, 2761 bp, Homo sapiens
  Payload ID: 6686
  Gene Symbol: GABRA5
  Gene Name: gamma-aminobutyric acid (GABA) A receptor, alpha 5
  Uniprot ID: P31644
  ENST ID: ENST00000400081
  CDS Start-End: 399-1787
gagtgcgccgggggcgctggggggctctgcggcgggcggcgcgcggcccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcaggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagccgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaattaggaaagtactgcatgatcttacacgaagaaatagaataggcaaacttttatgcaggcagattaataacagaaatacatcatatgttagatacacaaaatatttccctgaggaaaaaaaatcaactgcttaaattttttgggaagaaaaagaaacatttcttaccccacaccacccactacctgaacaatagccaagaaaggaaaggagatgttaaaacaaacagtgttttgatgacattctcagcacttggcccatgtgatcgctgtctctgaaacactgaccacctctccctacagccagcgtgtagtgcttcagtggtgagaaattgtaattgagttattttccattttatttccttgtatgtatttcatgactggacttactgctctgtcagcttttgtatatgaatcttaaatgttcattaaaaaataaaaaatgaactgatcttgtgg

SEQ ID NO: 136359 - DNA, 570 bp, Homo sapiens
  Payload ID: 6686
  Gene Symbol: GABRA5
  Gene Name: gamma-aminobutyric acid (GABA) A receptor, alpha 5
  ENST ID: ENST00000554083
  CDS Start-End: 314-570
gctaattggttgttaaaaatggctaaaatattgacataaaccaattccttagaatcacagaatgatagactttgagcctcaggttaggtggttggataactagccccaagcagagtatccttggatgttggagaactgaggtgtatcaaggccaaacaatcccctaggcactatgggagctgtgttctcagatcctcgtctcaggagacaagcctccacgtgactccctggtttctgtatcttgagaagaatttgtaagaaataatatgttttaacgcttcctcttgtttctctttttaaaagcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcct

SEQ ID NO: 136360 - DNA, 549 bp, Homo sapiens
  Payload ID: 6686
  Gene Symbol: GABRA5
  Gene Name: gamma-aminobutyric acid (GABA) A receptor, alpha 5
  ENST ID: ENST00000555182
  CDS Start-End: 51-549
gatcctccagcccagagacgacatgtggcgctcgggcgagcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaatt

SEQ ID NO: 136361 - DNA, 650 bp, Homo sapiens
  Payload ID: 6686
  Gene Symbol: GABRA5
  Gene Name: gamma-aminobutyric acid (GABA) A receptor, alpha 5
  ENST ID: ENST00000554599
  CDS Start-End: 154-650
acgtactttctcagtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcg

SEQ ID NO: 136362 - DNA, 728 bp, Homo sapiens
  Payload ID: 6686
  Gene Symbol: GABRA5
  Gene Name: gamma-aminobutyric acid (GABA) A receptor, alpha 5
  ENST ID: ENST00000554596
  CDS Start-End: 283-728
ggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcaggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcc

SEQ ID NO: 136363 - DNA, 458 bp, Homo sapiens
  Payload ID: 6686
  Gene Symbol: GABRA5
  Gene Name: gamma-aminobutyric acid (GABA) A receptor, alpha 5
  ENST ID: ENST00000555060
  CDS Start-End: 411-458
gctcgaggccaggggacttggagtcgctgctgcaccgcgcgctcccagcccaggaggaaggcgctgcctggcggagcgcttggctcgtacccggggcaggagcaggggaagtctgcgaaagccgggagcgagccggggagggccggggagctggagaccctcggcgtgccgctgcggaccgcgcgggtggcgaccgcgggtgccagggcgacccaggctgcggctccgcagtgcagcccccgcgcccacctgccctggcgcgccggccctgtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctcctt

SEQ ID NO: 136364 - DNA, 653 bp, Homo sapiens
  Payload ID: 6686
  Gene Symbol: GABRA5
  Gene Name: gamma-aminobutyric acid (GABA) A receptor, alpha 5
  ENST ID: ENST00000554038
  CDS Start-End: 396-653
ggcgcgcggcccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcagggtgagccctgggcgcgctgggccggggcagtgggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccg

SEQ ID NO: 136365 - DNA, 2128 bp, Homo sapiens
  Payload ID: 6687
  Gene Symbol: GABRA6
  Gene Name: gamma-aminobutyric acid (GABA) A receptor, alpha 6
  Uniprot ID: Q16445
  ENST ID: ENST00000274545
  CDS Start-End: 434-1795
aagatgccaatgctttccagatttcctcacagggccctgctaattccatgccaaaactggcagtggatttcttccttctaatctcccttaatgccttattcgattattgtcactgctctccgaccatgcactgtcccttcagactctcctttcccaactgagtcagtcagaggagcctgggtgtctgcaggacataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggca

SEQ ID NO: 136366 - DNA, 573 bp, Homo sapiens
  Payload ID: 6687
  Gene Symbol: GABRA6
  Gene Name: gamma-aminobutyric acid (GABA) A receptor, alpha 6
  ENST ID: ENST00000523691
  CDS Start-End: 1-573
ttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctacaatgtgcactttgaaggaaaaaaagacaactcgtcaaattcactgctatatttaatttgtttcaaatatttagatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagca

SEQ ID NO: 136367 - DNA, 591 bp, Homo sapiens
  Payload ID: 6687
  Gene Symbol: GABRA6
  Gene Name: gamma-aminobutyric acid (GABA) A receptor, alpha 6
  ENST ID: ENST00000520000
  CDS Start-End: 1-591
acattgaggatggaccagtaggtgttctggggactctgttccaggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattcttt

SEQ ID NO: 136368 - DNA, 555 bp, Homo sapiens
  Payload ID: 6687
  Gene Symbol: GABRA6
  Gene Name: gamma-aminobutyric acid (GABA) A receptor, alpha 6
  ENST ID: ENST00000517823
  CDS Start-End: 1-555
agtaggtgttctggggactctgttccaggtacagatggctgtagcattcataagagggtatttatagagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaagg

SEQ ID NO: 136369 - DNA, 2393 bp, Homo sapiens
  Payload ID: 6687
  Gene Symbol: GABRA6
  Gene Name: gamma-aminobutyric acid (GABA) A receptor, alpha 6
  ENST ID: ENST00000523217
  CDS Start-End: 243-1574
acataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatgacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcagataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatggctttcagtggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatg

SEQ ID NO: 136370 - DNA, 2143 bp, Homo sapiens
  Payload ID: 6688
  Gene Symbol: GABRB1
  Gene Name: gamma-aminobutyric acid (GABA) A receptor, beta 1
  Uniprot ID: P18505
  ENST ID: ENST00000295454
  CDS Start-End: 293-1717
aatgcatgaaggaaactccgtttacacatgctcgtaggatcccctgcgtggaaacagcagcttgtctctgactacccggaggacatggagcaccccaaataggaactttagagggattgaaatctgttgcctgttccactaggaatattgtttgcaaggcacaaggtgtcttttggtagtgagcgcgctctgcgcatgcgcaggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccattggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacagtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggttttaggtcttgcatatcagttttattactgcaccatgtttacttcaaaaagacaaaacaaaaaaaaaattatttttccagtctaccgtggtccaggttatcagctctttaagagctctattaattgccatgtttacaaacaaacacaaagagagaagttagacaggtagatctttagcagtcttttctagtttccctggatttcactgatttattttttagggaaaatgaaaagaggaccttgctgtccgcctgcactgcttcctggtaaactataacaaacttatgctgccaaaaaaaaaaaaaaaa

SEQ ID NO: 136371 - DNA, 576 bp, Homo sapiens
  Payload ID: 6688
  Gene Symbol: GABRB1
  Gene Name: gamma-aminobutyric acid (GABA) A receptor, beta 1
  ENST ID: ENST00000513567
  CDS Start-End: 224-576
gcgcgcttgcgctgcaagactcggcaagtttgttccgactgtaactccggggatgaggaacggggtctctcgcccctcctccggcttcgcagcccccgaccccaagtgggctccccgcccacagcagtgttcgtcctcctacctcctggccccctcccttccgctgggatttggatctaaccaatgaagctcctctgtcatcagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctcta

SEQ ID NO: 136372 - DNA, 563 bp, Homo sapiens
  Payload ID: 6688
  Gene Symbol: GABRB1
  Gene Name: gamma-aminobutyric acid (GABA) A receptor, beta 1
  Uniprot ID: P18505
  ENST ID: ENST00000510909
  CDS Start-End: 20-283
cttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggaggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccattggatgagcagaactgcaccctggagatcgaaagttatggctataccactgatgacattgaattttactggaatggaggagaaggggcagtcactggtgttaat

SEQ ID NO: 136373 - DNA, 1963 bp, Homo sapiens
  Payload ID: 6689
  Gene Symbol: GABRB2
  Gene Name: gamma-aminobutyric acid (GABA) A receptor, beta 2
  Uniprot ID: P47870
  ENST ID: ENST00000353437
  CDS Start-End: 322-1746
accccaagcttgctgcctcctccgggtcccggcggccacggcgaggcggcctgagcttcaggaggaagggaagaggcagcctctgggtgtgcgagtcccctgggcgcggggaagggaagaagaggacgaggtggcgcggagaccgcgggagaacacagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagt

SEQ ID NO: 136374 - DNA, 7409 bp, Homo sapiens
  Payload ID: 6689
  Gene Symbol: GABRB2
  Gene Name: gamma-aminobutyric acid (GABA) A receptor, beta 2
  Uniprot ID: P47870
  ENST ID: ENST00000274547
  CDS Start-End: 219-1757
gcgcggggaagggaagaagaggacgaggtggcgcggagaccgcgggagaacacagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagattttttataaagatattaaacaaaatgggacccaatatcgatccttgtgggaccctactggaaacctctccccaactagacggactaccaattacgatttctctctgtatacgatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagtgatttttacacatggtggctagacagcctgagtgctccatgttgtctgtttagtatgcagcctactcagaggggaataatttggaagatattcttagaaggctcaacagcattgtcagtcatttggtcataaccagatactcctcatcttcctttttaaggtcggcatgctgttgagatggcattgtccttatgaaacattatctgtaatgccatgcaaacacattacttgaagatgatctatgattttcttactgagatgataatggtgtcatgggaagattattcccactggtttctaaaagattctcttgtgatttgagcaggctaggggaatcaagacagagactcaggaaaccgatttggccagtccctttgcttgagcacggagaatcaactatgatgtctttcattttggcatttagagatgaggagacttctggacaatatcatgcatggtggccaagaaaatttttgctaaacggctatttcctaggtggttaaagtaagagttaacaacacagagcagagtagaaaatcagaaacgacggttgtaacaaaaagcaagcaagcaagaaagcatgacccttatcagctccacacagcatctggtctatacatactgtgtctagtggcagagggtgagtaagagagattgtttttccaacatcactagcttttgacagcatacctaaagaggtttttatagtttaatcgaagataaccatgaaatacaaaaattagagaaatgagaattgtcttagatattcaggttagattcagagtcattcaaatatacaaatacagagcacaaactagcaaacagattgtttttctcagacgaagtcagctgtccctgcaatttttgtccctataattttatttcttaatttaatagagtatttcaagagaaggatttgttcatcactttaaaggattcatggtcctctccagctttttttttgcttccaaaattctgattatattcttaggagactggcaaagtaaggctttggagagattgagtgaactatattttcttatatgcaatgaaattcaccattgtatttttcaaagcaaataatacttcaaggagtatgaacacacagagagttaatttgtgcattcattggtttggggcttgattttcttaagagtgctttcattgtatatgttgcaatctgcctaatcaaggaaaatatgaaaactagtggaaaataataacaaagccacattaacatgataaatgttatgagcctcagttgatattgcagaaaaatatataactgttaatcaggcaggcatgatgtattttttttctatttttaagttatgccattgtgcttctttctacactaattggacataagcattcatatgttggacaagaggagaataagctaatatgtcttccttctatcaatataaggctcatattttgcttttcttatagaaaatagtgaattgctaaattttccttaaagttgaatttgattgaactttttcttggaggatgactttgctatttctattttgaaaacaaagaaagctcttctttttagagtaatatccctaattgtgcatagcagccagtatccacctgtgaataatgtatgttttcttgattccttgtttccttcatgatttagcagcttggaatatgatggagtactattgcccttgcattccagctgtccaagaacaacaacaaacctttatccttcagctttctgaatttgccccaaaatggaatggtattttgtttttcaccagtgtaggaaaccttggccattatattttgattacataatcttgagcacctctgagtatcatctttgggcagaatctgaccaagattcttctcacaggctcagagtagagattcctcatgtttctccaggacacactttctcctaggcaatcattttggggcatcacactaagtaaagtgcctgccccttgtcaacagggggtaaagtttgactaaaaaacatcaggaaggaacatattgataactcaggggcacaactccaaaatgccattctgaaaaggctcttctagagtcaactcagagcccaagtgtagaagtgggctcttatgtgcaatcactgtacaagccataaaaatctttgatattgccatttatgattacaacaaaattttagatgtccaagaaagtcaacagaacaatccagatcaaagtgtagagaagcatctttgcagcttgagcctcaaaagcataaaaccaggaattcatttctgctctcagtgatacaagaaacaaggcaaaggaaaaaagatgggaccttagaagcaatgccctagagtaaaaagcatacattggcactcagtaaccacagagatagaaacaactgactcagcctctccagaaataacagtagatgtagaatttgttcttaaatatatgtttcgttgaaatgaaatgcagtcatcaaatgcgaggaggggtgctagacctgataagtctaggaagaccagtcagcttgatagccagttgttaaactaaaggaccacaaaggtgtgtttagtagttctgatatgggattactatcagtttatacatatgtatagattttcttttaattataaacagccagatagccagcaattaaggtgttttttcatctttgtgaaattcatggacaaattctgactctaaaatgcacagtctacatgaaatctttgatctcaatctgtatatatatatattgtacatgaccgctagtaggtatgaaatgcatttcagagttgaaaactcatgcaacataatcatgtgtttgcataaggaatgttaaaattctttctactacaatttattaacaggggaaaagattcaagcagtgccatctagaccttttctcttctcatttcttcaaaagcagtgctaagtaaaataataataataaaaatggtttatgaaccaaaagactttacattctagcattaggaacacacacaaaaaaatctgtcagcttacaaaagcacaacacataaagaaagagcagtggaatgcgtaatggggaaatgaatcatgtttaaagcaagacttgcattaaattggcaactaagataatttccattttctataggtaaccgtgttccagtttaatgattaccttcatactcaacaagaaaaatggcaaagcaacatcatcaaaataggtcttacaacatatctacatgtatatatgtgtatatatagattcatataaacatacatacatatatatgcattcatatgttggaaaacaaaaggaataagctaatatgttttatttccttcattaaaccagtatatgagtatttttaatttggcaaacaaaaatcaacatactgaaataagtaatacagggtactgagcatttctctatcagcaaatcaatgcctacagtttttatgaaccattgcacagttcaactcgacaatagtactgtaccccagaacatcagaagttaagtagttgtcacattgcttgtctaattgctctctttttcaaggaaacaaataacattgtccattggtgagtcaaaaacaaacatgtcttaagaaaatgaaaaatgataaaaattcctccaaagaggaagaaaaaaaaaaaactaaaccccaccatgttggttagggcaaaatactaagtattcacaactgtagcaatcatgccatttggctaaatgtacagagtacatgtaatgtgagcaaccataactttcactgaacgtgtgtaaatattaaaacagatttcttaaatatttttaacttctaatttgtattttatggtaaggcaatgtgctaattccgtttatggcttaagttgatgtgttataatatgtaaataattaaacatgctgtaaatgaatagtcaatagatacaaataattgtttagtttttttcttaatttttatttattttttactaagtactattactgcagtgcccccagcagagtaatttaaacacccttttgcataaatggtttgggaatcccagacagaagggtttcaatttgctatcacacacacagtcacacacagtcacacacacacacacacacacactcaaacacacataatcttttgctcacccactctgtctctctgcccgtctatgggaaacactctactatttatgtagtcaatataacaaacaagagatagcctttgaaatggcaattgggaaaagcaaaaatgatcattgataacttaatagacttttttatatgtcagagttcaagaaaccaaagtttgcaacttaaatctcagttttcaaacagtaaaagtttgtatagatggcactacagaaaaataaaaatggttattcctaccagctccagaaatgtgttacacaatatacactagaagactttttttttaataatagtattttgtccttaggtagtattgttcctttcaaccaaagactccagaattattgaaaaacaaaaaaggaaaaaaaaaatgagataatgggggaaaaaaaggacgctgcttcacaccaaaggtttaaaaaaatattttccaaatgcactaggaacattgtaaaaaccagaaaggagtgaacagaatgctaatgaagatactgccctaaagaaatctgtacaaaaaaaaaaaaaaaaagcagcactcttaaaaagctactaggtttttggaaattgaagtaaaatatttctgtagatatattcaaaattctgacatcaaattttaatttgcttaaagaagttttatttgtgatgaagatcaatatgattcaaatgatgaaaaacaaaactgtatgtcctttgagttcccaaaccaaatgtcactgccgtgtcacatcctctaatctgatgcccatgtgtgtgtccttgcgccatttgaagcaagttgacagttccatcagtttgtttttgtttttgtttttggttcaataatttgagttcaaccatcgtcattttaaacataattaatcccaacaaagttgcctatagtttaatttaaacctcacagcatttttaatttattttgcatgggtgtttaaatagttctgttacgaatattgtccctgcacagttctaaattgtccttttataaaaaaaaaaagtgatattctagtttcttcacaatgtagtgattatcagccttactaattaccttgtagcctttcttaatatgcacataatgcacattttccgatggctagaaaaatgcaaaacacagtggatatcattgcatctattttcatgtctttctaaaaacaggactattaaaatctctgggatacatgagatagtaaaaaatgaggattataaatgaatagcacataagaattattttcttgaatttaaacttattgcagccagtttcagcatgtaaatatataataatgttggctagtgtgtaattcttgaactaagaaatataaataaaaataaaaagattgtg

SEQ ID NO: 136375 - DNA, 7191 bp, Homo sapiens
  Payload ID: 6689
  Gene Symbol: GABRB2
  Gene Name: gamma-aminobutyric acid (GABA) A receptor, beta 2
  Uniprot ID: P47870
  ENST ID: ENST00000393959
  CDS Start-End: 1-1539
atgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagattttttataaagatattaaacaaaatgggacccaatatcgatccttgtgggaccctactggaaacctctccccaactagacggactaccaattacgatttctctctgtatacgatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagtgatttttacacatggtggctagacagcctgagtgctccatgttgtctgtttagtatgcagcctactcagaggggaataatttggaagatattcttagaaggctcaacagcattgtcagtcatttggtcataaccagatactcctcatcttcctttttaaggtcggcatgctgttgagatggcattgtccttatgaaacattatctgtaatgccatgcaaacacattacttgaagatgatctatgattttcttactgagatgataatggtgtcatgggaagattattcccactggtttctaaaagattctcttgtgatttgagcaggctaggggaatcaagacagagactcaggaaaccgatttggccagtccctttgcttgagcacggagaatcaactatgatgtctttcattttggcatttagagatgaggagacttctggacaatatcatgcatggtggccaagaaaatttttgctaaacggctatttcctaggtggttaaagtaagagttaacaacacagagcagagtagaaaatcagaaacgacggttgtaacaaaaagcaagcaagcaagaaagcatgacccttatcagctccacacagcatctggtctatacatactgtgtctagtggcagagggtgagtaagagagattgtttttccaacatcactagcttttgacagcatacctaaagaggtttttatagtttaatcgaagataaccatgaaatacaaaaattagagaaatgagaattgtcttagatattcaggttagattcagagtcattcaaatatacaaatacagagcacaaactagcaaacagattgtttttctcagacgaagtcagctgtccctgcaatttttgtccctataattttatttcttaatttaatagagtatttcaagagaaggatttgttcatcactttaaaggattcatggtcctctccagctttttttttgcttccaaaattctgattatattcttaggagactggcaaagtaaggctttggagagattgagtgaactatattttcttatatgcaatgaaattcaccattgtatttttcaaagcaaataatacttcaaggagtatgaacacacagagagttaatttgtgcattcattggtttggggcttgattttcttaagagtgctttcattgtatatgttgcaatctgcctaatcaaggaaaatatgaaaactagtggaaaataataacaaagccacattaacatgataaatgttatgagcctcagttgatattgcagaaaaatatataactgttaatcaggcaggcatgatgtattttttttctatttttaagttatgccattgtgcttctttctacactaattggacataagcattcatatgttggacaagaggagaataagctaatatgtcttccttctatcaatataaggctcatattttgcttttcttatagaaaatagtgaattgctaaattttccttaaagttgaatttgattgaactttttcttggaggatgactttgctatttctattttgaaaacaaagaaagctcttctttttagagtaatatccctaattgtgcatagcagccagtatccacctgtgaataatgtatgttttcttgattccttgtttccttcatgatttagcagcttggaatatgatggagtactattgcccttgcattccagctgtccaagaacaacaacaaacctttatccttcagctttctgaatttgccccaaaatggaatggtattttgtttttcaccagtgtaggaaaccttggccattatattttgattacataatcttgagcacctctgagtatcatctttgggcagaatctgaccaagattcttctcacaggctcagagtagagattcctcatgtttctccaggacacactttctcctaggcaatcattttggggcatcacactaagtaaagtgcctgccccttgtcaacagggggtaaagtttgactaaaaaacatcaggaaggaacatattgataactcaggggcacaactccaaaatgccattctgaaaaggctcttctagagtcaactcagagcccaagtgtagaagtgggctcttatgtgcaatcactgtacaagccataaaaatctttgatattgccatttatgattacaacaaaattttagatgtccaagaaagtcaacagaacaatccagatcaaagtgtagagaagcatctttgcagcttgagcctcaaaagcataaaaccaggaattcatttctgctctcagtgatacaagaaacaaggcaaaggaaaaaagatgggaccttagaagcaatgccctagagtaaaaagcatacattggcactcagtaaccacagagatagaaacaactgactcagcctctccagaaataacagtagatgtagaatttgttcttaaatatatgtttcgttgaaatgaaatgcagtcatcaaatgcgaggaggggtgctagacctgataagtctaggaagaccagtcagcttgatagccagttgttaaactaaaggaccacaaaggtgtgtttagtagttctgatatgggattactatcagtttatacatatgtatagattttcttttaattataaacagccagatagccagcaattaaggtgttttttcatctttgtgaaattcatggacaaattctgactctaaaatgcacagtctacatgaaatctttgatctcaatctgtatatatatatattgtacatgaccgctagtaggtatgaaatgcatttcagagttgaaaactcatgcaacataatcatgtgtttgcataaggaatgttaaaattctttctactacaatttattaacaggggaaaagattcaagcagtgccatctagaccttttctcttctcatttcttcaaaagcagtgctaagtaaaataataataataaaaatggtttatgaaccaaaagactttacattctagcattaggaacacacacaaaaaaatctgtcagcttacaaaagcacaacacataaagaaagagcagtggaatgcgtaatggggaaatgaatcatgtttaaagcaagacttgcattaaattggcaactaagataatttccattttctataggtaaccgtgttccagtttaatgattaccttcatactcaacaagaaaaatggcaaagcaacatcatcaaaataggtcttacaacatatctacatgtatatatgtgtatatatagattcatataaacatacatacatatatatgcattcatatgttggaaaacaaaaggaataagctaatatgttttatttccttcattaaaccagtatatgagtatttttaatttggcaaacaaaaatcaacatactgaaataagtaatacagggtactgagcatttctctatcagcaaatcaatgcctacagtttttatgaaccattgcacagttcaactcgacaatagtactgtaccccagaacatcagaagttaagtagttgtcacattgcttgtctaattgctctctttttcaaggaaacaaataacattgtccattggtgagtcaaaaacaaacatgtcttaagaaaatgaaaaatgataaaaattcctccaaagaggaagaaaaaaaaaaaactaaaccccaccatgttggttagggcaaaatactaagtattcacaactgtagcaatcatgccatttggctaaatgtacagagtacatgtaatgtgagcaaccataactttcactgaacgtgtgtaaatattaaaacagatttcttaaatatttttaacttctaatttgtattttatggtaaggcaatgtgctaattccgtttatggcttaagttgatgtgttataatatgtaaataattaaacatgctgtaaatgaatagtcaatagatacaaataattgtttagtttttttcttaatttttatttattttttactaagtactattactgcagtgcccccagcagagtaatttaaacacccttttgcataaatggtttgggaatcccagacagaagggtttcaatttgctatcacacacacagtcacacacagtcacacacacacacacacacacactcaaacacacataatcttttgctcacccactctgtctctctgcccgtctatgggaaacactctactatttatgtagtcaatataacaaacaagagatagcctttgaaatggcaattgggaaaagcaaaaatgatcattgataacttaatagacttttttatatgtcagagttcaagaaaccaaagtttgcaacttaaatctcagttttcaaacagtaaaagtttgtatagatggcactacagaaaaataaaaatggttattcctaccagctccagaaatgtgttacacaatatacactagaagactttttttttaataatagtattttgtccttaggtagtattgttcctttcaaccaaagactccagaattattgaaaaacaaaaaaggaaaaaaaaaatgagataatgggggaaaaaaaggacgctgcttcacaccaaaggtttaaaaaaatattttccaaatgcactaggaacattgtaaaaaccagaaaggagtgaacagaatgctaatgaagatactgccctaaagaaatctgtacaaaaaaaaaaaaaaaaagcagcactcttaaaaagctactaggtttttggaaattgaagtaaaatatttctgtagatatattcaaaattctgacatcaaattttaatttgcttaaagaagttttatttgtgatgaagatcaatatgattcaaatgatgaaaaacaaaactgtatgtcctttgagttcccaaaccaaatgtcactgccgtgtcacatcctctaatctgatgcccatgtgtgtgtccttgcgccatttgaagcaagttgacagttccatcagtttgtttttgtttttgtttttggttcaataatttgagttcaaccatcgtcattttaaacataattaatcccaacaaagttgcctatagtttaatttaaacctcacagcatttttaatttattttgcatgggtgtttaaatagttctgttacgaatattgtccctgcacagttctaaattgtccttttataaaaaaaaaaagtgatattctagtttcttcacaatgtagtgattatcagccttactaattaccttgtagcctttcttaatatgcacataatgcacattttccgatggctagaaaaatgcaaaacacagtggatatcattgcatctattttcatgtctttctaaaaacaggactattaaaatctctgggatacatgagatagtaaaaaatgaggattataaatgaatagcacataagaattattttcttgaatttaaacttattgcagccagtttcagcatgtaaatatataataatgttggctagtgtgtaattcttgaactaagaaatataaataaaaataaaaagattgtg

SEQ ID NO: 136376 - DNA, 2030 bp, Homo sapiens
  Payload ID: 6689
  Gene Symbol: GABRB2
  Gene Name: gamma-aminobutyric acid (GABA) A receptor, beta 2
  Uniprot ID: P47870
  ENST ID: ENST00000520240
  CDS Start-End: 389-1813
gcgcggggaagggaagaagaggacgaggtggcgcggagaccgcgggagaacacagtgcctccggaggtgaggggctcttcctcattttgcctgccttctagggaccgctccggcttcttgtatccagaggtacagcccctgaacagccgggagtccccgtcccctgtcccggacgaggggccgggggcgccagctccgcacgccgcgggagtgggcggcgagcgcgggcctgcgaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagt

SEQ ID NO: 136377 - DNA, 1349 bp, Homo sapiens
  Payload ID: 6689
  Gene Symbol: GABRB2
  Gene Name: gamma-aminobutyric acid (GABA) A receptor, beta 2
  ENST ID: ENST00000517547
  CDS Start-End: 222-1166
aagttggatctcctctcttcagtgaaaccctcaattccatcaaaaactaaagggatgtggagagtgcggaaaaggggctactttgggatttggtccttccccttaataatcgccgctgtctgtgcgcagaggtccccccgtggctgtggggatgaacattgacattgccagcatcgatatggtttctgaagtcaatatgaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacact

SEQ ID NO: 136378 - DNA, 1779 bp, Homo sapiens
  Payload ID: 6689
  Gene Symbol: GABRB2
  Gene Name: gamma-aminobutyric acid (GABA) A receptor, beta 2
  ENST ID: ENST00000517901
  CDS Start-End: 327-1562
gagtcccctgggcgcggggaagggaagaagaggacgaggtggcgcggagaccgcgggagaacacagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagt

SEQ ID NO: 136379 - DNA, 2470 bp, Homo sapiens
  Payload ID: 6689
  Gene Symbol: GABRB2
  Gene Name: gamma-aminobutyric acid (GABA) A receptor, beta 2
  Uniprot ID: P47870
  ENST ID: ENST00000612710
  CDS Start-End: 134-1075
tcagtgaaaccctcaattccatcaaaaactaaagggatgtggagagtgcggaaaaggggctactttgggatttggtccttccccttaataatcgccgctgtctgtgcgcagaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaaggtaaattcagagggcaagccctccttgcttcttaaactcatggaagaatgctagcaatacaggttgatgaccttgttgagcaaatgaggaaaccaagcccagggaagagaatgggtaattttccccaaagcacacaaacaattaatgatggaagcacaattagggaccaaactcatgacacaagatttggatgccctttccattaacaagaggagtgaccaaacatgagaagacctttatgatgctttctcacatattgagtatagtacctataattatttatgcattctttaaatttattcacctaatttatttaaaaaggaaatttaatgttgcttcagtcagtattacttgctggacaatagctttacaaatatataagtaacaaatttaaaaaactatatcattaagttctaatttatactagatgaagtctctggccctgaaatctgcattctctttgacttaaaggaaagataagcaagtatacagatgtgttacagacccaccaagcaacaaactgagactttttctttgaagcgatcagaagaacataagaagagtaagggggaaaagacaaataattttctcctttaaatgacaatgccttgcacatataccacttatcattgcagcatttgactatatgaggccaccatcttgcttaagtcagacatggtcaaagattcccacaaaactataaaccctgtttatttgttaagtcagtagttttcaatcatgggtgccaatggaatgacctgaacagattaaaaaaaaatactgaagccttggtcccctccccagaaaatctgatttgattttcttggagaaagcatgggcaacacaattttaaaaagttccccaagttattctaatctgcatccaaatttgagaatcaccactttaaggtttttgatggtagtcccagtagagccagctctctttactctcaatattaaacttcacctggcttcctgttatagcacttgctgcactaacagaatacttgtatatgtatcttcccagaggccacatttagacctttagcaatagccaaagaaaagtcttattttcatatctgccctaaatactgtttatgaagtagtgtctaatattggaccaataaatagttcatcatgatgggactaggaaaacattaatcaatcctcttaaaccatttggaattattaattataacaaaagctgattatttccttgatgttttgatatttctaacttcaaattaatttcaaggatagcaaagtataaataatctctgccattgagttgtatttggagcaaaccatatggaagcttctaactcagtaatgtttttcacatatccataggtctaatatttggttttagactcttctctaatccaaggcacttcttgcttagaagatgatatttgcaacaatgcaaattttaagtatggcccttggaaac

SEQ ID NO: 136380 - DNA, 4494 bp, Homo sapiens
  Payload ID: 6690
  Gene Symbol: GABRB3
  Gene Name: gamma-aminobutyric acid (GABA) A receptor, beta 3
  Uniprot ID: P28472
  ENST ID: ENST00000299267
  CDS Start-End: 65-1486
tttggctgctcggagagtaggggggagagcggatcccagcaggttaggccggaggaacagcgccatgtgctccgggctcctggagctcctgctgcccatctggctctcctggaccctggggacccgaggctctgagccccgcagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttc

SEQ ID NO: 136381 - DNA, 5781 bp, Homo sapiens
  Payload ID: 6690
  Gene Symbol: GABRB3
  Gene Name: gamma-aminobutyric acid (GABA) A receptor, beta 3
  Uniprot ID: P28472
  ENST ID: ENST00000311550
  CDS Start-End: 113-1534
tccgggccagcgcggcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaa

SEQ ID NO: 136382 - DNA, 1900 bp, Homo sapiens
  Payload ID: 6690
  Gene Symbol: GABRB3
  Gene Name: gamma-aminobutyric acid (GABA) A receptor, beta 3
  Uniprot ID: P28472
  ENST ID: ENST00000400188
  CDS Start-End: 88-1296
agtcacaacttccggttagcgtggcggaggctctcggagtctttgggacctcagcaccgggataccgggagactccctcgtgtccccatgtgggccacctaccagacagaagaggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatgg

SEQ ID NO: 136383 - DNA, 1267 bp, Homo sapiens
  Payload ID: 6690
  Gene Symbol: GABRB3
  Gene Name: gamma-aminobutyric acid (GABA) A receptor, beta 3
  Uniprot ID: P28472
  ENST ID: ENST00000545868
  CDS Start-End: 101-1267
ggaaaactgcttacatggaaggcacttcaggggtaaggtccagggtgtgtgtctgtgcttggctctaggttgctccatttgggaggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactga

SEQ ID NO: 136384 - DNA, 5934 bp, Homo sapiens
  Payload ID: 6690
  Gene Symbol: GABRB3
  Gene Name: gamma-aminobutyric acid (GABA) A receptor, beta 3
  ENST ID: ENST00000541819
  CDS Start-End: 104-1693
acagagtccttcctgtttccagtctagaggctccagggaggtgagacgaccactcccaccagcagcaggccctgtgctggctgtgtcgcaggtgcagagtgagatgcagcagctcaggaggctctgggtcctggcagctcaacccttctgccacctaccagagaggtgtcgcctgttctttgaaatcgggggcatttcattggcgatgccccagtgccttctctggatttgcctggctgtgtgggaggcacgaggagacctcccattcattgctgagaatgatgccgtcctcacggtgaactggaacgcagtcaaagaacacagaacattttatgccatttatgaaaccagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactga

SEQ ID NO: 136385 - DNA, 817 bp, Homo sapiens
  Payload ID: 6690
  Gene Symbol: GABRB3
  Gene Name: gamma-aminobutyric acid (GABA) A receptor, beta 3
  ENST ID: ENST00000554556
  CDS Start-End: 96-413
gcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatgaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcg

SEQ ID NO: 136386 - DNA, 2109 bp, Homo sapiens
  Payload ID: 6690
  Gene Symbol: GABRB3
  Gene Name: gamma-aminobutyric acid (GABA) A receptor, beta 3
  ENST ID: ENST00000555632
  CDS Start-End: 53-316
gtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggctatgcaggaactgcacagctaggattcagccactgtggaactaacgtggcttatagattcattttttcctttccaggagtttggaattgaaaatgattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaag

SEQ ID NO: 136387 - DNA, 501 bp, Homo sapiens
  Payload ID: 6690
  Gene Symbol: GABRB3
  Gene Name: gamma-aminobutyric acid (GABA) A receptor, beta 3
  ENST ID: ENST00000556636
  CDS Start-End: 1-133
cttaaatgacaaaaagtcatttgtgcatggagtgacagtgaaaaaccgcatgatccgtcttcaccctgatgggacagtgctgtatgggctcaggtactatggccctggcctggaggaggtctggcacagctgagaacactgaagttaaattccccatggtggaaggtttgcagagagctggggttgttcctgctgttcctgcttgtaaagtactgctgaggaaggtcctgcccagcagagattgctttcctactgattatgtgcttgaaatactggttggactggctgtatcactgagaccttcagactgaatttctctcacccctggacactgagattggctctcaccttgtctatccagcagtagcctacactgcttgagctcagctgaatatgacggtgaactgagatccctgcaccagcttgtcagcatgtgatgggagagaatgctctggacagggtatgcatgccatcctaaaataaaacataaatccttgacaa

SEQ ID NO: 136388 - DNA, 5876 bp, Homo sapiens
  Payload ID: 6690
  Gene Symbol: GABRB3
  Gene Name: gamma-aminobutyric acid (GABA) A receptor, beta 3
  Uniprot ID: P28472
  ENST ID: ENST00000622697
  CDS Start-End: 466-1632
gctccgggccagcgcggcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggctatgcaggaactgcacagctaggattcagccactgtggaactaacgtggcttatagattcattttttcctttccaggagtttggaattgaaaatgattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacct

SEQ ID NO: 136389 - DNA, 5581 bp, Homo sapiens
  Payload ID: 6690
  Gene Symbol: GABRB3
  Gene Name: gamma-aminobutyric acid (GABA) A receptor, beta 3
  Uniprot ID: P28472
  ENST ID: ENST00000628124
  CDS Start-End: 168-1334
agagctgggctgttactggatatatgccatgtgagctggatggcctgtgaaagagaaaggcagttggtgataaaaataattggatgattcttaaagaaatagaagagacttgctgttggcagtgagaacccacaagaggcctctaaggagatgattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaa

SEQ ID NO: 136390 - DNA, 1928 bp, Homo sapiens
  Payload ID: 6691
  Gene Symbol: GABRD
  Gene Name: gamma-aminobutyric acid (GABA) A receptor, delta
  Uniprot ID: O14764
  ENST ID: ENST00000378585
  CDS Start-End: 101-1459
gcgcccgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcatgaaataaagccttggcctgggggccgcttcattc

SEQ ID NO: 136391 - DNA, 3152 bp, Homo sapiens
  Payload ID: 6692
  Gene Symbol: GABRE
  Gene Name: gamma-aminobutyric acid (GABA) A receptor, epsilon
  Uniprot ID: P78334
  ENST ID: ENST00000370328
  CDS Start-End: 55-1575
gccagagcgtgagccgcgacctccgcgcaggtggtcgcgccggtctccgcggaaatgttgtccaaagttcttccagtcctcctaggcatcttattgatcctccagtcgagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 136392 - DNA, 1324 bp, Homo sapiens
  Payload ID: 6692
  Gene Symbol: GABRE
  Gene Name: gamma-aminobutyric acid (GABA) A receptor, epsilon
  ENST ID: ENST00000441219
  CDS Start-End: 56-187
ggccagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcagaatatgaccacagcggtgtaaagaaagccaaatcaaggacccgaatgtgagcaggacctcagaagccccctttgtcactgcctcccagcaaaggcagcactatccggacttctaacaccatcgggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattagtttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccattcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaag

SEQ ID NO: 136393 - DNA, 619 bp, Homo sapiens
  Payload ID: 6692
  Gene Symbol: GABRE
  Gene Name: gamma-aminobutyric acid (GABA) A receptor, epsilon
  ENST ID: ENST00000417300
  CDS Start-End: 40-171
gcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcagaatatgaccacagcggtgtaaagaaagccaaatcaaggacccgaatgtgagcaggacctcagaagccccctttgtcactgcctcccagcaaaggcagcactatccggacttctaacaccatcgggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggaggtgaggagcagaacgacgttcttcccctcctagagggtccaggggttgagggcataggcatggagaatgcacctgggcagtaacagagggtgccatgctcatggacaggaacatctgctattgacctg

SEQ ID NO: 136394 - DNA, 6785 bp, Homo sapiens
  Payload ID: 6693
  Gene Symbol: GABRG1
  Gene Name: gamma-aminobutyric acid (GABA) A receptor, gamma 1
  Uniprot ID: Q8N1C3
  ENST ID: ENST00000295452
  CDS Start-End: 169-1566
attggctccctggctcaattctgctgggagtcgcatcctacctgtttgggaggtgcactgcctttccacactctcccttctgtactcagccagctgctgctgaggtgggaggaaaagtcctggctgggagaattgagctagtgcagcacacgtaaaaaagcgattccgatgggtcctttgaaagcttttctcttctccccttttcttctgcggagtcaaagtagaggggtgaggttggtcttcttgttactgaccctgcatttgggaaactgtgttgataaggcagatgatgaagatgatgaggatttaacggtgaacaaaacctgggtcttggccccaaaaattcatgaaggagatatcacacaaattctgaattcattgcttcaaggctatgacaataaacttcgtccagatataggagtgaggcccacagtaattgaaactgatgtttatgtaaacagcattggaccagttgatccaattaatatggaatatacaatagatataatttttgcccaaacctggtttgacagtcgtttaaaattcaatagtaccatgaaagtgcttatgcttaacagtaatatggttggaaaaatttggattcctgacactttcttcagaaactcaagaaaatctgatgctcactggataacaactcctaatcgtctgcttcgaatttggaatgatggacgagttctgtatactctaagattgacaattaatgcagaatgttatcttcagcttcataactttcccatggatgaacattcctgtccactggaattttcaagctatggataccctaaaaatgaaattgagtataagtggaaaaagccctccgtagaagtggctgatcctaaatactggagattatatcagtttgcatttgtagggttacggaactcaactgaaatcactcacacgatctctggggattatgttatcatgacaattttttttgacctgagcagaagaatgggatatttcactattcagacctacattccatgcattctgacagttgttctttcttgggtgtctttttggatcaataaagatgcagtgcctgcaagaacatcgttgggtatcactacagttctgactatgacaaccctgagtacaattgccaggaagtctttacctaaggtttcttatgtgactgcgatggatctctttgtttctgtttgtttcatttttgtttttgcagccttgatggaatatggaaccttgcattattttaccagcaaccaaaaaggaaagactgctactaaagacagaaagctaaaaaataaagcctcgatgactcctggtctccatcctggatccactctgattccaatgaataatatttctgtgccgcaagaagatgattatgggtatcagtgtttggagggcaaagattgtgccagcttcttctgttgctttgaagactgcagaacaggatcttggagggaaggaaggatacacatacgcattgccaaaattgactcttattctagaatatttttcccaaccgcttttgccctgttcaacttggtttattgggttggctatctttacttataaaatctacttcataagcaaaaatcaaaagaagtctgactaaattcagtagaatcttttgtgcttcagtaacttgaagtttaaatttaaaatgcagagagaccaatggttaaaatgtgaatagtattgtaactattttaaggccttcagaagtaaataaagtagcagctttcaggctaatttacgtgaaactgattagttgcaaaatccagtaggttaaaatactcacatatttttacttaaattttctttaatttacttatatgttattataattttgaatttttaagttctatgattcatgttttaaagatggaataattttaatacatattttgtttaaatataatctataattgttttgtaatgtaagactaattactaatatttatgtagcaacttttgtgccagaaaaaagactgttaatttgttttttcttgcttttcatttgattaccctgcttgaaatacagttagttgataacataaagccatagttttcttggattttcttccaagatattgtattcccaagaagaaattgatttatttttaaactatcagttactgaagacttatgaaaaggtcaatttttacctgtcttttaatccagtccattttctgacacaatattaaacagaacgccagttgcatttactttggtgatttgcaaacttggaatgaagccaccagtcattttttaagaatgcaagatgaaaaaatcaggtaaaatctaaccattttattctctgcttcatagcatttataatgtatgatgaggttaacactgaaatattaaaatctgcaaatgcacattaatgcaaattaaatgcagagagaaatgattatttttttctttatgttttatgaaagtgttgcagtccctaaaataaaaatattgaggaacattgcttgtatttactcacgtggttaaaaaattattacctggcaaactgagttgccggtcatattgaggacaaaatcttaaatatgtgctattagcattgtttttagactagtaatatgcagaaaacagttttaggcctgcgttacatattgcctcttccagctccaaagttttggaccctgtcagttttgcaactacattatacattattataatattcttttttttttctagaaactgggggcagcctcaaaatcatgttaaagagggagttttgttagaggcatctttaatgaacatgaatgtgagtgctctctaaattcttagcatctcactggatgtaaaatctatcagttaatagttttaaaaatgtctcttttgttaagaataaatttaggcttcaatcattataatcctgtaagtagcttgacataccaattgtttataagattcatcacataaatttctggagaaccaccaggtttagcttggaaataacctttaaagattgtttctgttgccaagaccaatgaccatgatgaagagttttatgatcacagcctatcttacttaaggtttgagaggaaacctgtcacctctgcaattgttactctagtttttaatgttataattccgctgcgtggttagtgaatgtctggcatgattatacacgtgtattggaaatatctagttttttaaatttttaattaatttatttataatttactgtgtgttcccagctaactctattttttttttcacttgctcataaacttctggaaaaaaataagcatgaatcaaatggtaatgcccaatatccaccgacactgcttttcttgaatgaacagccaaactaaactttggccatctatatattcatttacagattattcatacattcattttaataacattgagtactgatggatgttttgaaagtgagcattcatttaaggataaataaaaaataaagtagtaataaagaataaaatactttactaaaatattgtatggctattttcatgtttgaagctatagcttactatcatgagacagttttgattttgggactctttcaagtgtatctgagcatgactgtattttaaaatacttaaaagtgcttgatataaatagcttttccttctgaaccacgttctatgtaaaagaaaaaaaatagctttgattttctcactggtgtttcattaacttggttttaaatgttgacaatatttacaagtggaaataaaatttgtaaatatatgaaagatgcctttccttgtatataccatcaagcaagcactttgttttcaaagcaagtggtattttgatcagttttatttaaatgtgtgatcagaaagaatggcgtacaaatcttattatttctaaaaataagaataaaaaggtaaaactacatttagacttctttctcaagaaatcaaatacagctttttttcaaagctgattcagttcatttcctgttcctctattccaagtataagtttcaccaccttgagaaataatttttttaaaaaatcttcctctttctctggggagttatataataatttattgaatttattggaacttgattttcctggatgctttcaatgtttttaatgctaacatagaccccaaaattagatataaagaattgggaaggatacctggagcacaaggaataagatcatttgtaaaaatgtttgtttatatagacctatcctctaaatatgtgacaaggatctagaaattctgagaggggaaaatgtgattttggatttacaatgacagggtaatattttatttatcttcgaattccatggacaaaattaggctcacttaaattaatttttgtaaacccaagtaagttctaaaaaaaagtaaaaaatacatagaatacttgagaatttagcagggacagggaaaaatttcccagtaagtctgaagtcttgatgtaagtgggaattagataactaattggaggcattttattttaagttaaagacagatttctttaataagtttttaaaattgatcaactttaaattaagcacagtaaatgtgtataaatatgaaggcaatcataaggattttttcacttgtgtttccatattctggcattagtatatcatcataaaatagacaatgtttttgtctcaagaacaagaataaaattgaaatctgcattcatgccaattcagcataaaaaagaataggctacagttctctcacaccaagggccccatagttataaatgtgaaattatattccaggtcaaaatttgtgaaaaatacacaaaacactttgattttacaagagaggagctttaaataagatgattttagtagattgaaataaataaccagtatttaagtaaatgtataacgaatgaataaatacatgcataatattttcaaagttctataccagtacctatttttactcttacaaaatttcctgtaaaaaaatactacatttgaaattatttcattggttttagaactggcattgaaggtacccagtagactcttaagcctttactgcttgtctcactagaaacatttatttctgacctaccaagttttcttcacatcatcaaatttattcagcttctcagtgctgtaccgtatgatggcaagacatacttggtatttccatttttgttggtcattctttattgctttttactgctaggaaggtcttgccaggcttctatacagttacaaaaaccattaccaaactttatcaaggactttccaaatggagttttcaaatactattgaccacattgctctagttaatgtaaggtcagctctgactttttgtgtttgcatttcggaagtgaggtaacctcattcaaatatatatgcagcactttctgtgtacaaagtactgttctaaatacaaaagggaatataaagatgactttcaaggaacatataatgtagtcagaaagatgagaggattagttatacaatttaaggaagggaggataactttgggaaggttttgtggaggatatgtgtttagagatgcgagctggggattcaacaggtaagagggagagagatcacaatttccaactgggtaaacagcttgaaaaaagaaacagaagcctgggcacaaatgaaaattccatattaattggaagttaagattcatatagagacaatgaaaggttaggttagaacaataaactgagaagtacgaatgtggacttcaggaggctaggggaaattacgaagtcataaaaagttcacagagatacttgagtacaaaagatacattattaaaatttctgcagaagtttcatcttatttgtgtgtgatggtttggaatataacaagccagttaggcgtataagcttatagtggctaatatgaggatgaaatccgtactcttgtgacacaagtcttcagcggagatgggggatgataggcccaaatagaaagaaaagtggcagacattaagctttgactaacagacaacataactgagagacatggtgtgttgggtggaagggatcctgtagtagatacttgcttgcatgtagatgggtacaaagacaccataaggaaattctgaatgtaatacaaaggcttatttttcctgttgatttatctttttcacacataaaagatgaagaaaaaaataatctgaaatgtaaatcctaaagtgatctgtctagattcttattttttgaaaaatgttcctcactaaaagagttttctattcaaataaccatttccagttttctaactgagacatacatacatatatatatgtataaaattatatatatatttggacaaagagaataagagaattgcaggtagaaatagtctactgtgtgtagacaaatccagaaagttgatttctgttcctcaaacaatttctgaaatatttatgtcagaataaataaaagaattgttattgttggacaatgaaacatacctggaccctttgagtgtgtgaatagtaaaggctgtgataactgaaatgcagctaagcaaaaagggctaattagaagacttttgagacatgatttacctaaatggaaatagtttggttttcaatccttcactgtaataacaattatttgcatctattaagtgtttgtagtcactttgtataataaagttttatggcttgtgattataatggcttctgttattctgctactgcctcattgttttgaggaacatttgtaattttgtggcaaaggtgtctcaatttttcagtgttctttactctcatgatccttagaacaaaaaaaataccagtaacttgttataaataaagagtcacattctcttaaa

SEQ ID NO: 136395 - DNA, 4056 bp, Homo sapiens
  Payload ID: 6694
  Gene Symbol: GABRG2
  Gene Name: gamma-aminobutyric acid (GABA) A receptor, gamma 2
  Uniprot ID: P18507
  ENST ID: ENST00000356592
  CDS Start-End: 461-1888
attttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcatc

SEQ ID NO: 136396 - DNA, 1739 bp, Homo sapiens
  Payload ID: 6694
  Gene Symbol: GABRG2
  Gene Name: gamma-aminobutyric acid (GABA) A receptor, gamma 2
  Uniprot ID: P18507
  ENST ID: ENST00000361925
  CDS Start-End: 221-1624
tgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttc

SEQ ID NO: 136397 - DNA, 3927 bp, Homo sapiens
  Payload ID: 6694
  Gene Symbol: GABRG2
  Gene Name: gamma-aminobutyric acid (GABA) A receptor, gamma 2
  Uniprot ID: P18507
  ENST ID: ENST00000414552
  CDS Start-End: 226-1773
cagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttggtctcgttctattgcccaggctggaatgtgcagtggtgtgatctcggctcactacagccttcgcttctggggctcaactgatcctcccaccttggcctccagagtagctgggatttcagatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaa

SEQ ID NO: 136398 - DNA, 1961 bp, Homo sapiens
  Payload ID: 6694
  Gene Symbol: GABRG2
  Gene Name: gamma-aminobutyric acid (GABA) A receptor, gamma 2
  ENST ID: ENST00000523372
  CDS Start-End: 1-156
atgagttcgccaaatatatggagcacaggaagctcagtctactcgactcctgtattttcacagaaaatgacggtgtggattctgctcctgctgtcgctctaccctggaagaaaactttcttcttacccacataaattgagatttgaaaatgaatgaagaaaaacattgatagaaataacctcaatatcaagttggagatcctgacagagctaagtcatgttctacattcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaaga

SEQ ID NO: 136399 - DNA, 843 bp, Homo sapiens
  Payload ID: 6694
  Gene Symbol: GABRG2
  Gene Name: gamma-aminobutyric acid (GABA) A receptor, gamma 2
  ENST ID: ENST00000522053
  CDS Start-End: 177-843
aacagccagagagtaagtagaagctcatgaggctgaatgcttaggcctagcactggcacactcgcttttgtatatatattattagccgaagccaatcagatgatccagcccaaagtcgagaggcagaggaatagccttatccaggagaagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccc

SEQ ID NO: 136400 - DNA, 2145 bp, Homo sapiens
  Payload ID: 6694
  Gene Symbol: GABRG2
  Gene Name: gamma-aminobutyric acid (GABA) A receptor, gamma 2
  ENST ID: ENST00000522990
  CDS Start-End: 127-462
tgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatgcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattat

SEQ ID NO: 136401 - DNA, 1235 bp, Homo sapiens
  Payload ID: 6695
  Gene Symbol: GABRG3
  Gene Name: gamma-aminobutyric acid (GABA) A receptor, gamma 3
  ENST ID: ENST00000333743
  CDS Start-End: 269-1135
ggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaactattccctcctggacatgaggccaccaccaactgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacac

SEQ ID NO: 136402 - DNA, 717 bp, Homo sapiens
  Payload ID: 6695
  Gene Symbol: GABRG3
  Gene Name: gamma-aminobutyric acid (GABA) A receptor, gamma 3
  ENST ID: ENST00000451330
  CDS Start-End: 1-509
gtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaagccatcctgctgccctgcctgtggcctccaagggttgccctttagatctctggtgagccatccccgcatcagcagagccttctgcctccccgtctaagtcagaatcttcctgtgtggctgccttaccttgcaaatggccagacttctcctctgtgtctccggtagctcccagttccatccacatagcaagggactacacagaggcatgaagcaacgagtggatgaatgtctggctgatcactgtcaaagcacacgtgtaggaaacctttattgcaattgtttgttaataaaggcagatctttcaa

SEQ ID NO: 136403 - DNA, 342 bp, Homo sapiens
  Payload ID: 6695
  Gene Symbol: GABRG3
  Gene Name: gamma-aminobutyric acid (GABA) A receptor, gamma 3
  ENST ID: ENST00000557596
  CDS Start-End: 1-116
atgctgagtgccagctgcagctgcacaacttccccatggacgaacactcctgcccgctgattttctccagctccaccatcttggccttcagattgtctcttcatgcatatcgctgacgtttaaaagtttcaagcttgatggtgtcttacagatcacctcctcggagactcgcttccattcgtggggaaatgaaggctcagagaggttgcatttgcctccatggggcccacagagctggctggtggttgctgtgaattgggaaatcacattttctgacttctcatcgcgtgttctcactactcaacactgggaggaaccattgaattaaaagttcaaaatcaa

SEQ ID NO: 136404 - DNA, 774 bp, Homo sapiens
  Payload ID: 6695
  Gene Symbol: GABRG3
  Gene Name: gamma-aminobutyric acid (GABA) A receptor, gamma 3
  ENST ID: ENST00000554696
  CDS Start-End: 1-774
gaagctggggtgaggggtacagaagaggatggctgctgggtatgcaacctagagtcagtcagtcagtcacaaacatggcaggaaaataagctgtctgaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatg

SEQ ID NO: 136405 - DNA, 1405 bp, Homo sapiens
  Payload ID: 6695
  Gene Symbol: GABRG3
  Gene Name: gamma-aminobutyric acid (GABA) A receptor, gamma 3
  Uniprot ID: Q99928
  ENST ID: ENST00000555083
  CDS Start-End: 144-905
agagtagatacctgtcccgcccgccgcggccagcagcctcggaggaagccagggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtaggaatttactgaaagaggcacagctctcaaaagccagagaggcctaaggccatatgtagtcatatccttaatgtacaagccttttgggcaaccatgatacataagtgatatttgagacaaaacaagtgattcaaagtgaaactatgttttcatgttttaattggtatgggagagggatgttagaaataattcatatttttgaatccaggctgtgtttgcataatgtctataaacctagctataaacttaacctaactcattactgaccatatttacataaaccaattttgctgatggggagagttctgcaaatttccacgtacataagaagaatcaaatattattgagaatccacacataaaagaagctggtgtgatatgtcctttgagtttcaattgcttttatttactctaagttttatctttaactttgagtttctttttcaatgattgaaagtaattacctaccaatttgattttatgaagtgatcattatatgcatattcaaaatcctgtaattaaataaaaagagttgttctgcctatgaa

SEQ ID NO: 136406 - DNA, 10768 bp, Homo sapiens
  Payload ID: 6695
  Gene Symbol: GABRG3
  Gene Name: gamma-aminobutyric acid (GABA) A receptor, gamma 3
  Uniprot ID: Q99928
  ENST ID: ENST00000615808
  CDS Start-End: 255-1658
gccgcccggttgcgcggaccggcgctagtgcgcgggtgggggcggcgcgccgcggtggcccggcgtcccgtgtgcgtccagtgtgcgccccgcgggggcgcggccagcgccagagtagatacctgtcccgcccgccgcggccagcagcctcggaggaagccagggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaactattccctcctggacatgaggccaccaccaactgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacactgcccagtgtatcttgttataaatgacctttcagcaacacaggaagtacccagcaaaggtttctattatgtattttacacacacacatacatacacacacacagctaattgagttttaaagtaatattcttgctaatccctactgaattgtagcttggtgttgtttctgaatggtttttggatattggaagcagccgctgattacccttgcaaagaaatctgtaaaatgtgcacgtgaatgtctgagatgctctctcaggcctctagtccttctgtatctttcctttgcagccctgggtgtagtagcactcaggagtgttgaatcacccctggccgagacccactcctgctggctcagcctgggcatgtgtgtgctccagtgtgaacagcagtgggttccaaccccagtctcctttctctgtggcctctctggctccagcaccatcatcgttagctggcactcctttacctaataacctcgttctaggcctggggagagtacactcgcattgtctacggtttccattggaggagaaaataagattttcaaaatgctcatgttgttggggtcaaagatgattatctctgaacatcagaaggttattactttattccaacttactgagagtcaacaatatttgaactttgggttcttggactagttcaacagcatttcaccttaagagctgtttttcactagaccaacgctcaaccctcgagtatgtgtccagcttatgttatattattatgggttcggtaattgtcattttgcaaagaaaggtatacagtgaacacaacctgttatcttgaagacatacaccggaatgtgaaagacatgtagataaaattttatttttattttatttttttgagacagagtcatgctctgtcacctggccaggctggagtgcagtggcacaatcttagctcactgcaacctctgcctcccatgttcaagcgattttcctgcctcagtttcccaagtggctgggactacaggtgtgcgctaccacacccggctaatttttgtatttttgttttttgttttttgggtttttttagtagagacggggtttcaccatgttggcctggctggtctcgaactcctgacctcaggtgatctgcccgcctcagcctcccaaagtgctaggattacaggcatgagccaccatgcccggccaaaattaaaaaaaaaaaattagtgaatattaattttcaactcaaaccaactttagatgcaaaaaaatgggcaatggtgatcatcaagtacatattttgatgaacaagattattttatactttgaaatatggatacatagcaaaatcccaaagaaaaaatatccccccaaatcaatactcttttgatatttttataatacaaaaccaacttgctgcttgctgttagttctttgttataactggatgccaatgtgaactgcagaagactgttttgaaacttctcctcaccaataggcaaaacacaagtcctaccagttagttaataatgctttggcattgttaaaatttgaaaccagaatctctgtgcttctcatctttctcacatagaaaactgaattaatttgacctagaaaccgtaatttttaaaattatctattgtgcataccataattacccagaaacgtaaaatattttgcagagaaagtatagaaaagtatcaatttcacacaatgtcctggatgtataccagacacagaagaggatgggagcagaagaggccagaaaaagtgaaattagattcatctgcttattcctattaagattgttgcatattaaacggatgcaaagatatagatatgtctgaatttccaaagatggagtctatacagcgtgagacattcaaacccattgtttctctccctgtcaactctctgtcttttggtttggtagttgctacataatccacaagccaattggcttcagtttagcaaattcagttttaaaaataaaagagtatttgtggagaaacaggttgaaaatattgtcttagatgcaatgtctcctctattggagaatttcacactctggtactctagttctgtctctcatgcataagcaacccccgccttggcagaagtattctgcaaggaccctgaccaaaggaatccaagtcacaccacagcactgagcgccaagggaaggtggcccaagggcagtcttaagacacaatgtcaaacgttatgaatgggtaatttctaacaagctgaagaactgcaacctgctacattgtaaacgaagttctggagagaactgaattttctagaaaaattcttattgggaggaaaataacctaaaacaactttttataacatggatttgtttgattttaccttaaaagaattttactgatgccttgtgtttcaaaaccactcaacatttggatattgttagcaaccctcctgaaattttacatgtaggataaatacaccaataacctcagttttctgaatccagccattctcttcttcccaacctcagcagccctcctgatcaaaacagatgagttcagcgctccttttctaggaaggagaaccttcatctcaagaaagtccaatggatttcactaactgagcatcatagtgtggattcctgcatatacagcaggctccccactagggggtctcaataaaaagagctaaagcaccccctaagagcatgtccatgccgggttctccgcaggcttgcataattcaagttctccatatcagtctcaactcctgagatgagccttttcagtccacaatgaggaagagatgggtgtgccttggtgaggtgcagagctcaggggatttttaatcatgtacatgtttactttctagaggaaggagaggagcagtgtggggagagtgggaaggaagtacgctttctttcactaaagactctctttgccaggatgcctgatcaggagggacgtgtgtgggcacgaggtgcaaggctgttccacacagctaagccccagcttgctttgcatgcagaattgggaaatatttggggtggaagttgtctgagtgatctgcattccaaaggtgctactgtgttcctcactttcagaaatactctaagttgaggagatgacagttctgtattttgacatggaatccaaatttctgaccactgtggatcacacttaaaactgtgactgtctgtcttttaagctgcatactgggtggggggaaagcaaagaaaaggcatttcacattaatggaattggagaaaaatgtctcttcagagcctagaaagcttcagcttctgcaaagtcccaacaccacctaccagaacagagactccctacataccagacagagaaggacaaagttagtataatttactctggacccagccaatactgcccccaatttacccaaaacatgccttaaaatgaaacagaaagctcaaataatacacatcttttaagattttccatttcctgcagttagctatatttcatgccaagttttatttatcttttatgaatggatggaaataggatttcatttctttatatgccaaacagtcttacccttaattttacatcaaaccaattaagtacaaagattttgcaggctctttgactgagaaaatgcgtgttctcaagagcaaagcattttcactctacataagggaaattggggccaatctaaaatgtcagcaacacagtcctgatggggatgagtgtctctaatagaaactccgcaccaaatcattttacctggtgatagcttgctgcagtaagtttgcaggcatgttgcttcgttgttctgcaatataaccacactcgaagcaacaggagaggggccggtaacccattctgcattgactccagctccctatgactaggaagcaatgagccactctatctaaagggctagaacacaaaacagacaaaacctcttcttccttgatcatttttatctcagctgccaaaatggaaattttctgtgatttcctttgagacttgaagaattacacctggtctccaaccattattcttatcaccgtatcggttcagtgctctcaaggcacaaagcacttggaattcactccatgatcttgcaactctttttgagtgcttttcctgagcgattttaaactctacccgtaagaaatttcatctgcaatttctgtaaaaaaaaaaaaaaaaaaaaagaatggcttaagctccacataatctgatgtaaatatacattgaaacgttaagttctatttgtactgaaacactgtccaccttagactttagaacactatcatttaacagatattcagaaaggttccggaaatacgggggaaagaaccagactacgaatacattggaaatgttaaatttacaatattctcctgagcccccttccaatttcccaaaattgagaaagtgtgtaatctgtacctattttttttctcaaattggcctggaggaaacattcaggttcagagagtttagcagtgcctctatgtttgtgttctctgtgtaatcacatgaaagaaccaacaaataactcttcaggataaatgacacctgcatcgctgatcccttgttgacttatgttttattataaaaatagatctctatcattatagggataaaacgtgtatgttttgagatgatttggtaagaactcagccattcagtatttctggaagaattaaaaacttggctttctttttcttaatgtctaatagttttgaagactagatattagggcattttctttcctccttttaaaatttctactgattacaagctagcaatttcaggatatcagcttgatctagttgtattaaggccaaaaggcagactttctttatatttatttttattatttatttatttatttatttatttatttatttatttattttgagatgaagttttactcttgttgcccaggctggagtgcagtggcgccatctcggctcactgcaacctccacctcccgggttcaagcaattctcttgcctcagcttcccgagtagctgggattacaggcacccaccaccatgtctggctaattttttatatttttagtagagatgggctttcaccatgttggccaggctggtctcgaactcctgaccttcaggtgatccacccgccttggcctcccaaagtactgggattacaggcgtgagccaccgcgcccaacctgtatttacttttttaatgccacctagctgaataatgctttgggttttactgttgtcaataaaaccccttataccttttattgtcctgcttacttataaaagccaaattttaggcgaacttaaataaatcagtgctgaaaaactagttgaacaatcagtcactgacaagttttcaatgttttgagttaaccaagtgggcttttcagattaggttattcaagagcatgagctagaaaataattaggcagacaaaacatatgttctcacacacacaccacttccaaaacagacatgatttgaatgtagcattcaggttattgaggtgaacgtaaattgctttgcttgaacaattgagataatcacctactttcgccacttcacttttcacatttgtaaacacacacagggtttttccagcccagtgagcaggctacacaatgtgaggatgataatggttcctgcagggaagccagagcctctatgtctgccgaacagtttaaattgaacaggttggaaagaacattgattgccaataattaaatgccccagactgagcaggtagctgctacattttctcttctcttttctagttattcagggttccttctttgattttcatgagaaaggaacatttacacttcctgtgaggggcttagactccgatttctcccagttgcctcacttactgaagttcgatcccagtgaatgatgtgtatgtacccaacacatccaatttgtattttcttaaatatgtgtttcttaggtatctaaggatacatgagcgagcccacagcacaattattgcagtccccaagatgtcagtcttctcaaaatgacaacattgtcactaaccactttttaaaaaagaactgaaattcccattttttgttaaacgtttttccaatacatagcaatgtgtaaaatagactcccaaatctcctttgggaaaggaacctgtggaccctggagctaagttgtcattttagggacatggtgataatcaggactgatgccagtaagtgggaagttcattacggcaaggcagtgggaaggtgccagcatcccctttccacctgagatgggctgaattttcacccggaagtctgaagcctctggaagggcaggtggaatcgctcctggcaagggcatgaccgtgcacaggctgacatgattttccttttgggtggattggagttttacaactggattcattagcacacgtgtgggaacatgtgcctgtgcccacccacagcacttccttggaactctaagctgcttctctaatctaaggaggtctattcgaaaggatagtgcttgactttcaatttataaaagattattggaaacaccttaagtagtcctaacccactgtcagcttccaattttcaggagcaaatgatgactgctttgatttggttaggctttcttacaacaggtttttataaaatattgtttatatttgtaacaggaaggattttcaatgtcaatttcatccatgagtgaagaccccccactgcacagagcagcacttctgtcactctcatggggagatcagggtacccactcctctacgtagcttggcagacccagaccaccctgagccagcctgccacatccgctagtccatgcacctccagggtggccttgggagctacagagaggaaaaaaagaaaaaatgttgcattcttaagcaattaaagactccttccaatgtaattaaaaaataagtaatgtggcaaaagatgcacataacttgctccctcaagttctaaattgtcaccaaatatgaaaggtttttagatgaagtacatctacatcataaccatcatcaccctcattgtcctcttccatgtttctactagtactcagctattgattcaacacaaaggcttagagccttttctgaactataacgaaatcagaacttacatcgtggaaaaagcgaaaaagtttcattagagtttaaacattaagtatacagatcctactccaaaattttgctcgcctaaaacatttccagaactgctgtgttccccagcagtcctgcctgccctgcctcaatcagaatttcaaattactatttagaagaacattccattcaattgttgtttgttgattgctttctctctttttttttccgtttttaccttagttggctattttattccttttcgtaaagataacgtttgaattgtctaacaactatcttttttcactaaaatacatgcatctttggaaactgcaaattttgtgagctcaaaaagacaatcactgtgcttcttatcatctaatttgagtctaggctttgtttccccctaacttatcctggcatttttactttgaatagaaatagtcacaggcaaaatatattcatgaaatgtacagtgcttactattatatgatctctgtttagaataactattttattaaaacagtctaaaagacactgtccatcattcttgacatttgatatgtctaattttgtgctagtgaaccaagtttacctgctcacacgtttgtacaactacacaatgtgttttcctttacgtgcagctccggtactgagcaaaaggttcgttgtttaggagtgaaattttctgtgaaagttttgggagagtaattattttcagggatcagacctatgtgttgttaggagcaagaggccatcttgtgtttacatgcagtggtctgtgtatttgtgtctgtacgtacagtggtaaaactgaaacaacttattaataatgtgtgtcactctacccatcaccccaaatttagctgaaacaagtagaaaggagcgcagttttctagcgatagcgtattagcactaagcctctggttaggataaaaaggagcaagggagagggagaaagagaggacagagggagagagagaaagtggcaatctgtacatttcctgacaaagtgggatcatgttctttccaagaaaaggaaaagaaatccagcttcactacctgatcaggagtccctctggggtccacacaagcctgcctcctttggagagcccttgagcatcactgttgtgaccggggtgcacacctgggcgactccttgatcattcgtgcattctggtcaagttgacccgataagccaaaagtacttttcaagatttagatggcaaacagccatccccacccttgtctaggaagtcgtattcgcaggtcacaggaaggcgtcaggtcaggcttgaagcagccggggtgtgggcagggtcctctctctgtgaagcctgtgtgggaggtgaaactgtcaggggtcctgggagatggcccaggcaggaagggaaggagagaggcgcggactgctctctgttcccatggaatccttcctgcctgtgaagccattgtcctccagatgggaggtaggccgggagattccagaatccgaaaacattttggaatcatcttagagcaccggtgtggatgcgcttggccccgagggggccgcgccctgccccagtgcgtgcgcctcctgccccagcagggacccgccctcaccaagtggcctccagtagcccctgtgtccctgtcgtcccgcgagggattggaggccctggctccgggcggtcccgaggtcccgccgccctcctcccctgcgcagaggacgtggctccccgctatccgtgcggctcgtggtgtcctagtgaaatgagggcgcactggcgcccgacgtgccttggcgacacgggcggcgccgcgccccgcttcgtgcgtcccgtccccgccgtgccctcagctgggcctcgtggctgggccgccctctgtatttgtatttggattcctacgtttgtacttctaatacaaataaatgcacatgttgtcagaaatacctga

SEQ ID NO: 136407 - DNA, 3310 bp, Homo sapiens
  Payload ID: 6696
  Gene Symbol: GABRP
  Gene Name: gamma-aminobutyric acid (GABA) A receptor, pi
  Uniprot ID: O00591
  ENST ID: ENST00000265294
  CDS Start-End: 199-1521
agagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaa

SEQ ID NO: 136408 - DNA, 456 bp, Homo sapiens
  Payload ID: 6696
  Gene Symbol: GABRP
  Gene Name: gamma-aminobutyric acid (GABA) A receptor, pi
  ENST ID: ENST00000521009
  CDS Start-End: 180-456
aatcggacacgatcagcagggagaacacatgtgtttttatgagaattacgctgagataggtaacagatgaggatgaaatttgggcttgactgaagtaatgggggctgtctgtgaagccttgcggcagtacagcccaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctgga

SEQ ID NO: 136409 - DNA, 721 bp, Homo sapiens
  Payload ID: 6696
  Gene Symbol: GABRP
  Gene Name: gamma-aminobutyric acid (GABA) A receptor, pi
  ENST ID: ENST00000521481
  CDS Start-End: 208-721
aggtgggaaggctaaactgaggaattatgtctgacagaagggaatgacaaggctaaactgaagaattatgtctgacagaagggaagaaatgactgcagtggccttctcagaccctgtaggaaaggactctacttatccggtgaaagtgtctacctagactaagaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacac

SEQ ID NO: 136410 - DNA, 689 bp, Homo sapiens
  Payload ID: 6696
  Gene Symbol: GABRP
  Gene Name: gamma-aminobutyric acid (GABA) A receptor, pi
  ENST ID: ENST00000519196
  CDS Start-End: 512-689
agacgcgaaggaggctttgggttggggagaagggcagcaatgagatgcggctgcagtccaggaatagtcagggaaacagataatttggttaaaatatctcagcctaataagggaactgggcaggtggggataactaaaaaagagtgcataaaagagtgttgtccaagttggcaccagagtcggggagttttcaggggtttagaagcctggccgtcaatacccacaacagttatggaggcaagggaaacaggcccttgaaaagaaggtaatgtggagtgggtagcctccgtattgactaaggggacggacttaccttccactgtgagagttacccgaagctcggagtccgtgatggtctacggagcttccgaggcgatcgggcagcatcagtcttcagctgctaagccgagaaggagtcagtcagagagccttgggccagagttccaggggctctgggagtggctgccaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaac

SEQ ID NO: 136411 - DNA, 582 bp, Homo sapiens
  Payload ID: 6696
  Gene Symbol: GABRP
  Gene Name: gamma-aminobutyric acid (GABA) A receptor, pi
  ENST ID: ENST00000518122
  CDS Start-End: 426-582
tttgctccccttcctttctctctctcccttcccggctcctagactgggtctaggcaggagcttcgccatgatgtcaggagggaaggagatgcctctgggcctcgtaccacagcctcagctctctctctgcccctccatctgagtccctcctggctcccagctccctcagggtgcaaggccaagcctccaaggaatccctccccttacctgcatggctggagccaagaagagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctca

SEQ ID NO: 136412 - DNA, 3576 bp, Homo sapiens
  Payload ID: 6696
  Gene Symbol: GABRP
  Gene Name: gamma-aminobutyric acid (GABA) A receptor, pi
  Uniprot ID: O00591
  ENST ID: ENST00000518525
  CDS Start-End: 465-1787
ctgcccctccatttgctccccttcctttctctctctcccttcccggctcctagactgggtctaggcaggagcttcgccatgatgtcaggagggaaggagatgcctctgggcctcgtaccacagcctcagctctctctctgcccctccatctgagtccctcctggctcccagctccctcagggtgcaaggccaagcctccaaggaatccctccccttacctgcatggctggagccaagacaggtttagcagctccattcttccccagagagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaa

SEQ ID NO: 136413 - DNA, 700 bp, Homo sapiens
  Payload ID: 6696
  Gene Symbol: GABRP
  Gene Name: gamma-aminobutyric acid (GABA) A receptor, pi
  ENST ID: ENST00000522868
  CDS Start-End: 133-700
agtcaaggagtgagggacagggaatgaacatgccatggcacagggcaggacctgctgaaagacagacaggcccagcagcgtagagaagcggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagt

SEQ ID NO: 136414 - DNA, 1567 bp, Homo sapiens
  Payload ID: 6696
  Gene Symbol: GABRP
  Gene Name: gamma-aminobutyric acid (GABA) A receptor, pi
  ENST ID: ENST00000519385
  CDS Start-End: 193-1062
actccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaagg

SEQ ID NO: 136415 - DNA, 1284 bp, Homo sapiens
  Payload ID: 6696
  Gene Symbol: GABRP
  Gene Name: gamma-aminobutyric acid (GABA) A receptor, pi
  ENST ID: ENST00000519598
  CDS Start-End: 171-1220
tgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagataggcagaaaatatgttatctgtatgcagcataaaatcacaaccacaggagcaagcatccatgaagaatccaatatgaaaaaaacatgatcagctgct

SEQ ID NO: 136416 - DNA, 1823 bp, Homo sapiens
  Payload ID: 6697
  Gene Symbol: GABRR1
  Gene Name: gamma-aminobutyric acid (GABA) A receptor, rho 1
  Uniprot ID: P24046
  ENST ID: ENST00000369451
  CDS Start-End: 474-1652
caagatggccgaataggaacagctcccgtctacagctcccagcgtgagcgacgcagaagacggatatttttgatctgcacttggttgaatctacagatgtaaaacccacggatgcagagggctgactgtggctagaaaatgtgctgcagggagcacgtggaaacagctgatgagcacctgcagcccctgtttgggagcagctggggtgtgctgcctgccgttcacccatcagtcaaatcgaggcttcatgaaggcaaaggcagtggcatctcagaatttgacaaacctcctttcatcagtgactggttccatttcaggctggcccaaagtcaaagccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggttt

SEQ ID NO: 136417 - DNA, 3106 bp, Homo sapiens
  Payload ID: 6697
  Gene Symbol: GABRR1
  Gene Name: gamma-aminobutyric acid (GABA) A receptor, rho 1
  Uniprot ID: P24046
  ENST ID: ENST00000435811
  CDS Start-End: 456-1844
taataatggccgtaagcttaaaatagatccagggaggagctcattaacgtgaacatagaaagcagttccgcacctctggccttactcctcttggaaattgctttggtccatttttacttccttttattcgacgcaccagaaaataagacttttaccaacatttttactgcatttgacgatgaactaatttagaccggctaaaataattgttccactgggacacaggaattcaacctcagttcagaaaatccctgacatctgacgtaggaggatttataggtttagtggaaattgctttctcctgctctccagattgcatcctgtgggttgattttttttttgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatac

SEQ ID NO: 136418 - DNA, 1994 bp, Homo sapiens
  Payload ID: 6697
  Gene Symbol: GABRR1
  Gene Name: gamma-aminobutyric acid (GABA) A receptor, rho 1
  ENST ID: ENST00000457434
  CDS Start-End: 456-593
taataatggccgtaagcttaaaatagatccagggaggagctcattaacgtgaacatagaaagcagttccgcacctctggccttactcctcttggaaattgctttggtccatttttacttccttttattcgacgcaccagaaaataagacttttaccaacatttttactgcatttgacgatgaactaatttagaccggctaaaataattgttccactgggacacaggaattcaacctcagttcagaaaatccctgacatctgacgtaggaggatttataggtttagtggaaattgctttctcctgctctccagattgcatcctgtgggttgattttttttttgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagaatcgaggcttcatgaaggcaaaggcagtggcatctcagaatttgacaaacctcctttcatcagtgactggttccatttcaggctggcccaaagtcaaagccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctag

SEQ ID NO: 136419 - DNA, 2820 bp, Homo sapiens
  Payload ID: 6697
  Gene Symbol: GABRR1
  Gene Name: gamma-aminobutyric acid (GABA) A receptor, rho 1
  Uniprot ID: P24046
  ENST ID: ENST00000454853
  CDS Start-End: 112-1551
tgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcaggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatacacaataa

SEQ ID NO: 136420 - DNA, 3259 bp, Homo sapiens
  Payload ID: 6697
  Gene Symbol: GABRR1
  Gene Name: gamma-aminobutyric acid (GABA) A receptor, rho 1
  Uniprot ID: P24046
  ENST ID: ENST00000611484
  CDS Start-End: 819-1997
taataatggccgtaagcttaaaatagatccagggaggagctcattaacgtgaacatagaaagcagttccgcacctctggccttactcctcttggaaattgctttggtccatttttacttccttttattcgacgcaccagaaaataagacttttaccaacatttttactgcatttgacgatgaactaatttagaccggctaaaataattgttccactgggacacaggaattcaacctcagttcagaaaatccctgacatctgacgtaggaggatttataggtttagtggaaattgctttctcctgctctccagattgcatcctgtgggttgattttttttttgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagaatcgaggcttcatgaaggcaaaggcagtggcatctcagaatttgacaaacctcctttcatcagtgactggttccatttcaggctggcccaaagtcaaataggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatac

SEQ ID NO: 136421 - DNA, 2857 bp, Homo sapiens
  Payload ID: 6697
  Gene Symbol: GABRR1
  Gene Name: gamma-aminobutyric acid (GABA) A receptor, rho 1
  Uniprot ID: P24046
  ENST ID: ENST00000621627
  CDS Start-End: 417-1595
cagatatttttgatctgcacttggttgaatctacagatgtaaaacccacggatgcagagggctgactgtggctagaaaatgtgctgcagggagcacgtggaaacagctgatgagcacctgcagcccctgtttgggagcagctggggtgtgctgcctgccgttcacccatcagtcaaatcgaggcttcatgaaggcaaaggcagtggcatctcagaatttgacaaacctcctttcatcagtgactggttccatttcaggctggcccaaagtcaaataggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatac

SEQ ID NO: 136422 - DNA, 1682 bp, Homo sapiens
  Payload ID: 6698
  Gene Symbol: GABRR2
  Gene Name: gamma-aminobutyric acid (GABA) A receptor, rho 2
  Uniprot ID: P28476
  ENST ID: ENST00000402938
  CDS Start-End: 135-1532
ggccagccttgccctcacagcccctcagagcagcccgtcaggaggcagcagatggatcaatggtcaagccaggggggatttgctctgccacaggctactggaaagcagctttttgcctcacagatgtccacaaaatgccttattttacaagactcattttgttcttgttttgcttgatggttctcgtggagagcagaaaacccaagaggaagcgatggacagggcaggtggaaatgcccaagccaagtcacttatataagaagaaccttgatgtgaccaagatccggaagggaaagcctcagcagcttctcagagtggacgagcacgacttcagcatgagacccgccttcggaggccctgccatcccggtgggcgtggacgtacaggtggagagcctggacagcatctccgaggtggacatggacttcactatgaccctgtacctgcggcattactggaaggatgagaggctagctttctccagcgccagcaacaagagcatgaccttcgatggccggctggtgaagaagatctgggtccctgatgtcttctttgttcactccaaaagatcgttcactcatgacaccaccactgacaacatcatgctgagggtgttcccagatggacacgtgctgtacagcatgaggattacggtcactgccatgtgcaacatggacttcagccactttcccctggactcccagacctgttctttggagctggagagctatgcctatacagatgaagatctaatgctgtactggaagaatggggatgaatccctaaaaacagatgagaagatctccttgtctcagtttctgattcagaaatttcacacaacttccaggctggccttctacagcagcactggctggtacaaccgtctgtacattaacttcacgttgcgtcgccacatcttcttcttcttgctccaaacatatttccctgccactctgatggtcatgctgtcctgggtgtccttctggatcgaccgcagagctgtgcctgccagagtttcactgggtatcacgacggtgctgaccatgaccaccatcatcacgggcgtgaatgcctccatgccgcgcgtctcctacgtcaaggccgtggacatctacctctgggtcagctttgtgttcgtgttcctctcggtgctggagtatgcggctgtcaactacctgaccaccgtgcaggagcgcaaggaacggaagctgcgggagaagttcccgtgcatgtgtggaatgcttcattcaaaaaccatgatgctggatggaagctacagtgagtctgaggccaacagcctggctgggtaccccagaagccatatcctgacagaagaagaaaggcaagacaaaatagtggtccacctgggcctgagtggtgaagccaacgctgccagaaagaaggggcttctgaagggccagacgggttttcgtatcttccagaatacccatgccattgacaaatactctaggttgatattccctgcctcctacatatttttcaacttaatttattggtcagtgttttcctaggggctccaaggctgttcctagaagagggcatagacatcgagggggcctggccagtcattgacagacggacttgttgaccacacgcccctcaccaaacaatgcagcagctactggaccaccctgagcagcactcatctctcagagaagccc

SEQ ID NO: 136423 - DNA, 1416 bp, Homo sapiens
  Payload ID: 6699
  Gene Symbol: GABRR3
  Gene Name: gamma-aminobutyric acid (GABA) A receptor, rho 3 (gene/pseudogene)
  Uniprot ID: A8MPY1
  ENST ID: ENST00000472788
  CDS Start-End: 3-1406
agatggtcctggctttccagttagtctccttcacctacatctggatcatattgaaaccaaatgtttgtgctgcttctaacatcaagatgacacaccagcggtgctcctcttcaatgaaacaaacctgcaaacaagaaactagaatgaagaaagatgacagtaccaaagcgcggcctcagaaatatgagcaacttctccatatagaggacaacgatttcgcaatgagacctggatttggagggtctccagtgccagtaggtatagatgtccatgttgaaagcattgacagcatttcagagactaacatggactttacaatgactttttatctcaggcattactggaaagacgagaggctctcctttcctagcacagcaaacaaaagcatgacatttgatcatagattgaccagaaagatctgggtgcctgatatcttttttgtccactctaaaagatccttcatccatgatacaactatggagaatatcatgctgcgcgtacaccctgatggaaacgtcctcctaagtctcaggataacggtttcggccatgtgctttatggatttcagcaggtttcctcttgacactcaaaattgttctcttgaactggaaagctatgcctacaatgaggatgacctaatgctatactggaaacacggaaacaagtccttaaatactgaagaacatatgtccctttctcagttcttcattgaagacttcagtgcatctagtggattagctttctatagcagcacaggttggtacaataggcttttcatcaactttgtgctaaggaggcatgttttcttctttgtgctgcaaacctatttcccagccatattgatggtgatgctttcatgggtttcattttggattgaccgaagagctgttcctgcaagagtttccctgggaatcaccacagtgctgaccatgtccacaatcatcactgctgtgagcgcctccatgccccaggtgtcctacctcaaggctgtggatgtgtacctgtgggtcagctccctctttgtgttcctgtcagtcattgagtatgcagctgtgaactacctcaccacagtggaagagcggaaacaattcaagaagacaggaaagatttctaggatgtacaatattgatgcagttcaagctatggcctttgatggttgttaccatgacagcgagattgacatggaccagacttccctctctctaaactcagaagacttcatgagaagaaaatcgatatgcagccccagcaccgattcatctcggataaagagaagaaaatccctaggaggacatgttggtagaatcattctggaaaacaaccatgtcattgacacctattctaggattttattccccattgtgtatattttatttaatttgttttactggggtgtatatgtatgaaggggaattt

SEQ ID NO: 136424 - DNA, 1521 bp, Homo sapiens
  Payload ID: 6699
  Gene Symbol: GABRR3
  Gene Name: gamma-aminobutyric acid (GABA) A receptor, rho 3 (gene/pseudogene)
  Uniprot ID: A8MPY1
  ENST ID: ENST00000621172
  CDS Start-End: 118-1521
actgagtatggattgagcatcacactaaaaaccttccccggaaaaagggaccaaaggatgtaaactgaaaattttaaaaatctgctttgttttcctcaaattgctgaagatccagagatggtcctggctttccagttagtctccttcacctacatctggatcatattgaaaccaaatgtttgtgctgcttctaacatcaagatgacacaccagcggtgctcctcttcaatgaaacaaacctgcaaacaagaaactagaatgaagaaagatgacagtaccaaagcgcggcctcagaaatatgagcaacttctccatatagaggacaacgatttcgcaatgagacctggatttggagggtctccagtgccagtaggtatagatgtccatgttgaaagcattgacagcatttcagagactaacatggactttacaatgactttttatctcaggcattactggaaagacgagaggctctcctttcctagcacagcaaacaaaagcatgacatttgatcatagattgaccagaaagatctgggtgcctgatatcttttttgtccactctaaaagatccttcatccatgatacaactatggagaatatcatgctgcgcgtacaccctgatggaaacgtcctcctaagtctcaggataacggtttcggccatgtgctttatggatttcagcaggtttcctcttgacactcaaaattgttctcttgaactggaaagctatgcctacaatgaggatgacctaatgctatactggaaacacggaaacaagtccttaaatactgaagaacatatgtccctttctcagttcttcattgaagacttcagtgcatctagtggattagctttctatagcagcacaggttggtacaataggcttttcatcaactttgtgctaaggaggcatgttttcttctttgtgctgcaaacctatttcccagccatattgatggtgatgctttcatgggtttcattttggattgaccgaagagctgttcctgcaagagtttccctgggaatcaccacagtgctgaccatgtccacaatcatcactgctgtgagcgcctccatgccccaggtgtcctacctcaaggctgtggatgtgtacctgtgggtcagctccctctttgtgttcctgtcagtcattgagtatgcagctgtgaactacctcaccacagtggaagagcggaaacaattcaagaagacaggaaagatttctaggatgtacaatattgatgcagttcaagctatggcctttgatggttgttaccatgacagcgagattgacatggaccagacttccctctctctaaactcagaagacttcatgagaagaaaatcgatatgcagccccagcaccgattcatctcggataaagagaagaaaatccctaggaggacatgttggtagaatcattctggaaaacaaccatgtcattgacacctattctaggattttattccccattgtgtatattttatttaatttgttttactggggtgtatatgtatga

SEQ ID NO: 136425 - DNA, 6172 bp, Homo sapiens
  Payload ID: 6700
  Gene Symbol: GABRQ
  Gene Name: gamma-aminobutyric acid (GABA) A receptor, theta
  Uniprot ID: Q9UN88
  ENST ID: ENST00000598523
  CDS Start-End: 21-1919
gcgcccagaacgccccggccatgggcatccgaggcatgctgcgagccgcagtgatcctgctgctcatcaggacctggctcgcggagggcaactaccccagtcccatcccgaaattccacttcgagttctcctctgctgtgcccgaagtcgtcctgaacctcttcaactgcaaaaattgtgcaaatgaagctgtggttcaaaagattttggacagggtgctgtcaagatacgatgtccgcctgagaccgaattttggaggtgcccctgtgcctgtgagaatatctatttatgtcacgagcattgaacagatctcagaaatgaatatggactacacgatcacgatgttttttcatcagacttggaaagattcacgcttagcatactatgagaccaccctgaacttgaccctggactatcggatgcatgagaagttgtgggtccctgactgctactttctgaacagcaaggatgctttcgtgcatgatgtgactgtggagaatcgcgtgtttcagcttcacccagatggaacggtgcggtacggcatccgactcaccactacagcagcttgttccctggatctgcataaattccctatggacaagcaggcctgcaacctggtggtagagagctatggttacacggttgaagacatcatattattctgggatgacaatgggaacgccatccacatgactgaggagctgcatatccctcagttcactttcctgggaaggacgattactagcaaggaggtgtatttctacacaggttcctacatacgcctgatactgaagttccaggttcagagggaagttaacagctaccttgtgcaagtctactggcctactgtcctcaccactattacctcttggatatcgttttggatgaactatgattcctctgcagccagggtgacaattggcttaacttcaatgctcatcctgaccaccatcgactcacatctgcgggataagctccccaacatttcctgtatcaaggccattgatatctatatcctcgtgtgcttgttctttgtgttcctgtccttgctggagtatgtctacatcaactatcttttctacagtcgaggacctcggcgccagcctaggcgacacaggagaccccgaagagtcattgcccgctaccgctaccagcaagtggtggtaggaaacgtgcaggatggcctgattaacgtggaagacggagtcagctctctccccatcaccccagcgcaggcccccctggcaagcccggaaagcctcggttctttgacgtccacctccgagcaggcccagctggccacctcggaaagcctcagcccactcacttctctctcaggccaggcccccctggccactggagaaagcctgagcgatctcccctccacctcagagcaggcccggcacagctatggtgttcgctttaatggtttccaggctgatgacagtattattcctaccgaaatccgcaaccgtgtcgaagcccatggccatggtgttacccatgaccatgaagattccaatgagagcttgagctcggatgagcgccatggccatggccccagtgggaagcccatgcttcaccatggcgagaagggtgtgcaagaagcaggctgggaccttgatgacaacaatgacaagagcgactgccttgccattaaggagcaattcaagtgtgatactaacagtacctggggccttaatgatgatgagctcatggcccatggccaagagaaggacagtagctcagagtctgaggatagttgccccccaagccctgggtgctccttcactgaagggttctccttcgatctctttaatcctgactacgtcccaaaggtcgacaagtggtcccggttcctcttccctctggcctttgggttgttcaacattgtttactgggtataccatatgtattagtcccccagtgctccagaacagcgggagcactgtgctgtgctcctttcagtttcttttgggtttgtttttccctctttcctttgttccttttattttgtggttatttgggcaatccaataagttcatacttctctttataaacatgaggtggggagtaattggaaagaacatgttctagctggaagggaagggattgaggaggagttggaggtatacagcacatggatttcctttcctgctagaagactctcaccttttcaaagacttgtaacaaggaataagcatagaaaagcccctggaaatgtttagaggacagagaagagccaggttgggggatggggcaaggatctgggccttttgcccacaaacatttctggggggcttttctgtcccccttgaggtgtcaacatttctttttcattacatgttttcttctttttttgtttcctcctagggattatgggtcttgttcaccctctgcttagggctttatagaagaaagtcaagctgggttgggctggggttcatagctaaagggctagccatggcttagaagttcagggaacttcctataggaaacttagggagcatttgtaagtgcctttcccccactgtatggcatttgactgtggtgttttgatgcaagcgtggaaggggaatgtgggtggatggggctgcagagtgagacatcagggtgagagagcacatactcagcttgtggggttggcagagggtggggggtgatgtcaggttggaaattacacagttgagctggcctcttcggagggattggaacttgcctatatttctgcttcagaacgcttggcaatagagactcaatacatctgtctaagtcaggagttagctttccgtcagttgctgagttgatcaccagttacagcacttggtgaataagcactaaggttaggataattcacacttgctattttaccatctgatctagactagcagatgaatatctatcgtaagtctatatactaatcctttctatttgtctagtgcatagtaagtgtcaacaagctccctgacccattacatcactggagcctcacaggagccctgtaagccagggaaggcaaagcacattgtccccagtgttccaaggaaaacgaatggagcttatgccgcatgcttgaggacatgcagccagtgagtggtagatccaccccacttgctctttcttgtctttttcctcctgactgtcccaactgaggcatttccttttcttccctccctaaagagggtgctccagagggcccccaccacatcctctagcacctggggcatctctgcaggaataggctggtgaccagccaatgagcgtgacgtgagcagatggagaacacactctgcccactgagcagggcccctaacggaagtaggattggccagcattccaacttgccaagcagctccacctcactgatggaggttgtgagggagtgaactttgccgagcactcaacatatgccacctcttcctccctatgcagtctctccctcagtcccttacccctctacccactcaccctttaactgtgcttctgtgtttgtgtttctgtatatacctgggtgtatgcatatgcagcagggtgggtgtatgtacatatacaaccatttgagaagctgcatagtgccgtgtctagtggtgtaaatctacattggtgtgtacagaattgtatctacagcatgtggatgcatgcgtgtgtgtgcacatccctgtgaaagtgtggcttatgtatgtgtatgcttgtgtacacatgggtctatgctgagtgcatgtatataagggcatgtctgcatatctatgtttatctgatttgaatgggtgtgaaaggaaatacccctgaaagcatatgtattccctgttggtgacccttctagaaccactataattcccttggcctgctcccatatggtggaggggccctatttggccgggctgcttaactgactgtttctttccaacttcctgttccagggagcagcatctcccagttcccttccactgtttgccctgtccctccatccatctgtgctgtctcctagatagaagactggggaagtgaatgtagtcctaagaagtggtgagctagtgccttgaggtaggaagtggttaatccatggaagaagctgcaagtacagagcatttcactttgtcctagaggaacatgtttcggggtaacaggctggggagtgaggctgaaagaggcattgagaatagacacttgtacagtcacatacacatacacacacacaaatcttgtacgacagttgaaaacaagaaagttaccactggaagagctaaaattgcctctttatttttggataccccatacagagattcaggtggaggggagagcagtgactccatgtctgaagctcccaatgtggctattgaaaggctggcttcctggagcctaagcattggttggttgacgtggatttgggtctccagcaccctggaggtgctttcaaccctgtggtggcaagcagttcatttgggataaagtcataaagggagattggagcagtgtgaagaaaaggagggttttaagatttgtctggaagcaatgcacatgaaggcttcacagcacagaggaagggcagcgaggccagttgtaaatatctctatagatccatatagctagatataatactataccttaaaaaggatatcttgccctgacgtgctgcaatgagagcagttgaactctactgcgactcatactctgtaggttaagtgtcaaaatgaggtggagatttggcagtgacaccctttcgggaacgtgaaccttctgagtttgctatggatttggtcattttagcctgcacgttgccagatctccccttgttgagtcttgtatgtggtctgtcctctgtgtcatttgagtcctcagctgtccccaaccccttcccagcccctccccagcctgcagtcaccccctgtccagcaagctgcctccatcccatccctctcctcacctcacaccaggtaactctggaagtgcagaatgcttggtagtttggagcttgggcagcatctgggatgcaacaacccctattttactcttctacccaccttccatttctttccttcccatcgacttccccgacccaggatcccttctttgccactatcatgggaaggacacccctgtctgtctttctgaagtatcattttattgtggggatgtgtgacacgtttcctaccaagttcttgccagttccatctgccactgtggggtgcctttgcacaggtcatggacgatctgctgggtcttactagagcctgtcaaatgtattcttacaattcatgtcatcttgttaatagcaggacttcaaagtctttgcatatttagagctgagttttgctgagactgtggccattcctaatgaggtttcctcattccatatatataatagctaacccttaaagccattaactaatgaatgcatttattaagctatccactcgcatggtaccctgctgtggtgatgagcagtaactttctagctattccatagcccaacatcaaaggaaatcgtgactcgtcctactagaagtgtagtgtctttgtgtttgttgtgtagtgtcctgtgatcaatataaaatctatattatcagtgttgggttttcaggggagggagggagaggatgttaaagtctctctttgataaacttaaattatgaaatagcccagttgttcagggtcacttctattgactcaatttgtgtgagactttgcactcactatctcgccggccggactgcatgcccagggtcagtagtcagcagagctaaaggtgcccgaatttagcacagctggctgtggtgcctgacatagggcagtaccgggggattcttcagaggtcagccaagtcggtaacattctgtgaagcagattaaatacagtaaaatcaaacaaacggaggtctttggaagtgatgctgggcccaggcagtgaaaatcaagaaaagaggagaaagaccaagacctggatgtcctggacgacctgacccaaaaaggggcacaaagcagcagagcttcaccaggtgactgggtggcttctttgtcctcattaaatgtacatctttgcatgaaaaggaccttgactggtctggactttaacaaagtaaaatatgaagaaacgtaaaattatgcttctgaaaaatatactgaaataaaattttgtaaatagctaaaagaaaaataaataaatataataacaa

SEQ ID NO: 136426 - DNA, 3506 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000355973
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaa

SEQ ID NO: 136427 - DNA, 1739 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000376977
  CDS Start-End: 3-1739
agatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctga

SEQ ID NO: 136428 - DNA, 4104 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000377012
  CDS Start-End: 262-2796
acatctccctcctgctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtga

SEQ ID NO: 136429 - DNA, 4299 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000377016
  CDS Start-End: 287-2986
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136430 - DNA, 4527 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000377034
  CDS Start-End: 337-3222
ccctctcttccccccgccctgccttcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 136431 - DNA, 4070 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383537
  CDS Start-End: 223-2757
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136432 - DNA, 4299 bp, Homo sapiens; identical to SEQ ID NO: 136429
  Payload ID: 6701
  Gene Symbol: GABBR1
  Gene Name: gamma-aminobutyric acid (GABA) B receptor, 1
  Uniprot ID: Q9UBS5
  ENST ID: ENST00000383541
  CDS Start-End: 287-2986

SEQ ID NO: 136433 - DNA, 4510 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383542
  CDS Start-End: 312-3197
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136434 - DNA, 3523 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383543
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 136435 - DNA, 4070 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383636
  CDS Start-End: 223-2757
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136436 - DNA, 4299 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383637
  CDS Start-End: 287-2986
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136437 - DNA, 4510 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383638
  CDS Start-End: 312-3197
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136438 - DNA, 3523 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000383639
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 136439 - DNA, 4510 bp, Homo sapiens; identical to SEQ ID NO: 136433
  Payload ID: 6701
  Gene Symbol: GABBR1
  Gene Name: gamma-aminobutyric acid (GABA) B receptor, 1
  Uniprot ID: Q9UBS5
  ENST ID: ENST00000423604
  CDS Start-End: 312-3197

SEQ ID NO: 136440 - DNA, 3523 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000417759
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 136441 - DNA, 4070 bp, Homo sapiens; identical to SEQ ID NO: 136431
  Payload ID: 6701
  Gene Symbol: GABBR1
  Gene Name: gamma-aminobutyric acid (GABA) B receptor, 1
  Uniprot ID: Q9UBS5
  ENST ID: ENST00000446436
  CDS Start-End: 223-2757

SEQ ID NO: 136442 - DNA, 4299 bp, Homo sapiens; identical to SEQ ID NO: 136429
  Payload ID: 6701
  Gene Symbol: GABBR1
  Gene Name: gamma-aminobutyric acid (GABA) B receptor, 1
  Uniprot ID: Q9UBS5
  ENST ID: ENST00000443440
  CDS Start-End: 287-2986

SEQ ID NO: 136443 - DNA, 4298 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000419674
  CDS Start-End: 286-2985
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136444 - DNA, 3523 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000448754
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 136445 - DNA, 4509 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000439457
  CDS Start-End: 311-3196
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136446 - DNA, 3523 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000438094
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 136447 - DNA, 4065 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000414980
  CDS Start-End: 223-2757
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtga

SEQ ID NO: 136448 - DNA, 4070 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000452300
  CDS Start-End: 223-2757
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136449 - DNA, 3523 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000449163
  CDS Start-End: 248-2782
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 136450 - DNA, 4510 bp, Homo sapiens; identical to SEQ ID NO: 136433
  Payload ID: 6701
  Gene Symbol: GABBR1
  Gene Name: gamma-aminobutyric acid (GABA) B receptor, 1
  Uniprot ID: Q9UBS5
  ENST ID: ENST00000425097
  CDS Start-End: 312-3197

SEQ ID NO: 136451 - DNA, 4299 bp, Homo sapiens
  Payload ID: 6701
  Gene Symbol: GABBR1
  Gene Name: gamma-aminobutyric acid (GABA) B receptor, 1
  ENST ID: ENST00000440316
  CDS Start-End: 287-2986
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136452 - DNA, 4299 bp, Homo sapiens; identical to SEQ ID NO: 136429
  Payload ID: 6701
  Gene Symbol: GABBR1
  Gene Name: gamma-aminobutyric acid (GABA) B receptor, 1
  Uniprot ID: Q9UBS5
  ENST ID: ENST00000434660
  CDS Start-End: 287-2986

SEQ ID NO: 136453 - DNA, 4510 bp, Homo sapiens
  Payload ID: 6701
  Gene Symbol: GABBR1
  Gene Name: gamma-aminobutyric acid (GABA) B receptor, 1
  ENST ID: ENST00000418225
  CDS Start-End: 312-3197
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136454 - DNA, 4070 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000458612
  CDS Start-End: 223-2757
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136455 - DNA, 487 bp, Homo sapiens
  Payload ID: 6701
  Gene Symbol: GABBR1
  Gene Name: gamma-aminobutyric acid (GABA) B receptor, 1
  ENST ID: ENST00000476670
  CDS Start-End: 87-487
agtgggcgcagggcccagctgggggaagcggggctgggggagaggaggaaccgcggggatggaatcggggagcgctgaggcggccgatgccgggagcgtggatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggattt

SEQ ID NO: 136456 - DNA, 4212 bp, Homo sapiens
  Payload ID: 6701
  Gene Symbol: GABBR1
  Gene Name: gamma-aminobutyric acid (GABA) B receptor, 1
  ENST ID: ENST00000491829
  CDS Start-End: 86-499
gaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 136457 - DNA, 825 bp, Homo sapiens
  Payload ID: 6701
  Gene Symbol: GABBR1
  Gene Name: gamma-aminobutyric acid (GABA) B receptor, 1
  ENST ID: ENST00000485508
  CDS Start-End: 125-418
ctcttggtccccaggctgagcccggtcggagcctgcgaggcaaccggcaagaggtcgagtagtctccgggtgcgggccgcgccggcggggctcggtccagtcctcatggccgcctctcacttagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgcc

SEQ ID NO: 136458 - DNA, 2364 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000494877
  CDS Start-End: 1-1737
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctc

SEQ ID NO: 136459 - DNA, 4286 bp, Homo sapiens
  Payload ID: 6701
  Gene Symbol: GABBR1
  Gene Name: gamma-aminobutyric acid (GABA) B receptor, 1
  ENST ID: ENST00000472823
  CDS Start-End: 283-678
gggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggca

SEQ ID NO: 136460 - DNA, 609 bp, Homo sapiens
  Payload ID: 6701
  Gene Symbol: GABBR1
  Gene Name: gamma-aminobutyric acid (GABA) B receptor, 1
  ENST ID: ENST00000462632
  CDS Start-End: 140-609
acacacacacccctccacttcaaggtatagccaagagcttctggagccgtcaaaaaggtctgtacctgctgtctttagagcttccagtttgcccttggtcaagaaatactgtttgctaggctctgctggagtacatcagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactg

SEQ ID NO: 136461 - DNA, 871 bp, Homo sapiens
  Payload ID: 6701
  Gene Symbol: GABBR1
  Gene Name: gamma-aminobutyric acid (GABA) B receptor, 1
  ENST ID: ENST00000489385
  CDS Start-End: 75-656
gaggtcgagtagtctccgggtgcgggccgcgccggcggggctcggtccagtcctcatggccgcctctcacttagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaag

SEQ ID NO: 136462 - DNA, 1739 bp, Homo sapiens; identical to SEQ ID NO: 136427
  Payload ID: 6701
  Gene Symbol: GABBR1
  Gene Name: gamma-aminobutyric acid (GABA) B receptor, 1
  Uniprot ID: Q9UBS5
  ENST ID: ENST00000548767
  CDS Start-End: 3-1739

SEQ ID NO: 136463 - DNA, 1739 bp, Homo sapiens; identical to SEQ ID NO: 136427
  Payload ID: 6701
  Gene Symbol: GABBR1
  Gene Name: gamma-aminobutyric acid (GABA) B receptor, 1
  Uniprot ID: Q9UBS5
  ENST ID: ENST00000547410
  CDS Start-End: 3-1739

SEQ ID NO: 136464 - DNA, 1739 bp, Homo sapiens; identical to SEQ ID NO: 136427
  Payload ID: 6701
  Gene Symbol: GABBR1
  Gene Name: gamma-aminobutyric acid (GABA) B receptor, 1
  Uniprot ID: Q9UBS5
  ENST ID: ENST00000551140
  CDS Start-End: 3-1739

SEQ ID NO: 136465 - DNA, 1739 bp, Homo sapiens
  Payload ID: 6701
  Gene Symbol: GABBR1
  Gene Name: gamma-aminobutyric acid (GABA) B receptor, 1
  ENST ID: ENST00000550820
  CDS Start-End: 3-1739
agatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctga

SEQ ID NO: 136466 - DNA, 4199 bp, Homo sapiens
  Payload ID: 6701
  Gene Symbol: GABBR1
  Gene Name: gamma-aminobutyric acid (GABA) B receptor, 1
  Uniprot ID: Q9UBS5
  ENST ID: ENST00000546913
  CDS Start-End: 1-2886
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 136467 - DNA, 1739 bp, Homo sapiens; identical to SEQ ID NO: 136427
  Payload ID: 6701
  Gene Symbol: GABBR1
  Gene Name: gamma-aminobutyric acid (GABA) B receptor, 1
  Uniprot ID: Q9UBS5
  ENST ID: ENST00000551423
  CDS Start-End: 3-1739

SEQ ID NO: 136468 - DNA, 1739 bp, Homo sapiens; identical to SEQ ID NO: 136427
  Payload ID: 6701
  Gene Symbol: GABBR1
  Gene Name: gamma-aminobutyric acid (GABA) B receptor, 1
  Uniprot ID: Q9UBS5
  ENST ID: ENST00000552399
  CDS Start-End: 3-1739

SEQ ID NO: 136469 - DNA, 5788 bp, Homo sapiens
  Payload ID: 6702
  Gene Symbol: GABBR2
  Gene Name: gamma-aminobutyric acid (GABA) B receptor, 2
  Uniprot ID: O75899
  ENST ID: ENST00000259455
  CDS Start-End: 461-3286
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaaaaaaaaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttcccactaactttgtttctgaccaaagtgaattggaggcactctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacacaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaa

SEQ ID NO: 136470 - DNA, 550 bp, Homo sapiens
  Payload ID: 6702
  Gene Symbol: GABBR2
  Gene Name: gamma-aminobutyric acid (GABA) B receptor, 2
  ENST ID: ENST00000634457
  CDS Start-End: 1-550
gtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtcca

SEQ ID NO: 136471 - DNA, 7569 bp, Homo sapiens
  Payload ID: 6703
  Gene Symbol: GGCX
  Gene Name: gamma-glutamyl carboxylase
  Uniprot ID: P38435
  ENST ID: ENST00000233838
  CDS Start-End: 82-2358
cggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaatttatcttcattgcaattttggttccttctttgttcctattatctatatacacccagtgtttcactagcagttatgagagcagtcagaatagcagcatcaaagttaaataaggaaatctagatgattgctagattttctctaaaaataagcttagtatttggtattattctagcctttggtgagcagaaggggaggtaaagtaagaattaactaaatttagtaagggattagggaatgcttagacattttgtaggttggggtatacaagggtaactcaggaagctcctcagttcagtgaaaattcaaagggttggcactgagctaggaagcgagaatgcagggttatgaaaaaggatccctgctttgggagctcatggacttgtagcagagaccggtagtaaattggcagtctcagtaacttctgtaaatgattgcatctctttgcaggcttctcttcccatactctcccccactcctccttggacagtgttccgggggttctttcctaagcaactgctttttcagtatacatacttcagatgattgtgtctactccaggatttccaacgatgctaggtttctttcctgtgccctagacgtataggtctaagttccacctggatatcccacagggctatcaagctcagttcatcctaaacagaacttacattcatccccaactcagacttccttattctttattattgaatggcagctctgtaccttagccaagctgttatctctaggtcatcagccttgactcttcctttttccttgcatttcttaaaattgccaagtcccatcaattttacctcctggatacctcttgaatctatttttttttaaagacagggtttcactctatcacccaggctggagttcagtggcacaatcttggcttactgcagccaccacctcctgggtttaaacgattcttccacttcagcctcccatgtagctgggactacaggtgcccaccaccacgcccaactaatttttgtatttttagtagagacatggtttcccacattggccaggctggtctcaaactcatgaccttaagtatccacctgccttggcctcccaaagggctgggattacaggtgtgagccaccgtgcccagccaaatctgttttcattactacctatatctgtattttcaacctttgtattagcatctagttagggatagaccaggacagggccgacatgttagttgtcaagcagattgccaccctcccccaccactgaggaggccaaatggagtttggtggaaaatctctaattcattcaaggtattatatgggcaagcaatggctgtggcacagggtcccctgattactttgtaagaatgggtgggagggatgctgattttcaatccttttgcagatcttctctcatagtaacacaatagaagatactttgccactatgttgtttgccaaactcactgtacctacttgactggtaacaaaagtcccaagagttacttgggagaagacacttgaaaaagtatttttctaaatatgggcaaggatgctgcccttccccaaactgttagtataccacctctctgaccaattttcccaaggaagatattggggtagggtgaggtgtaaagaaaaagtggtcatgtaaatactggtaataaaagctgttcagtggggtagagttgggttgcaactgtagccattctaaaaatgggctatcaatgtccttttagccaaaagactttagtatacatcctcctcattctaccctcaggatttggatctttgcccctgatgggtatccatcccctttgaaactttagaaaggcaggttatatacagaatgttcaacctaaagacatttccttaagtcatactttcatgctttctaaactataatcacccttatcatcccctgctgttatgctttccctctgctccctgtggcctaatgttcctccaccaccttattaaccttcaggatacttttcccctaggctgggcaggacaacactatccccttggtccacaagctccctcaaggttggggaatctttgtttacttagcaaatactgaacataaccttaaagcggttacttttgaaaacttctcatgctattctaccaacttggaggcacctatccatgctcattcccctaatgtagccaatatggttatctgcaatgtattggcatctaaaaactcccttatgaaactgccagacttgttctggaacatttcaattacatgcaaaattcaggttctcaagttggaacaagtctaattgacacacctgcataggttttaaccttgccctccccctacttcccaacagatttccaagttttttgagaaggaaccttgctctggcccaggctggagtgcaatggcgccatctcggctcactgcaacctctgcctcctgggttcaagtgattctccagcctcctgagtagctgggattacaagcacctgccaccacacccagcttttttgtatttttggtagagacggggtttcagtttgccaggctggtatcaaaccgtgacctcaggtgatccacccgcattagcctcccaaagtgctgggattacaggtgtaagctaccatacccagatttccacggctttttttttaagtctcactctgttaccctggccggagtgtggtggcacgatttcagctcactgcaagctccacctcccgggttcacgccattctcctgcctcggcctcctgagtagctgggactacaggtgcctggctaacttttttatatttttagtagagacagggtttcactgtgttagccaggatggtctcgtgatctgcatgccttggcctcccaaagtgctaggattataggctcacgcctatattactatatagtggcctatattacaggccactccgcctggcctccaaatttccaagtttttaagtctccatgcaaacaggcataagcaagcactccttggctctacatttgcaggacaagctggaccaccattcagatgttggtagaaatgtaatccaagtggctattctctatgcatgtagctcctaggttcaagagcagtgtggtctgcggattttctacacaacctgccataaatgaaatttaagcctttggaaatttatagcattttcagctaatttgcattatttatctctgcaagatattgactagaaatcacgtttcagaacttctcagatgaaaacatcatacaacccttaaaactaagctcataatttaaaaatgtatgcagattaataggcttaaattgccaggactttagatagacattaccacttccaggttaatacttttagcggtttttatgccttcaatggtttgaagccctcaaccttagttgaaaacttaaaaatggcattgaatggctgctgcaataaggacacatgaattttggcttaagtggactaggaggactaaatcttgcttaggcttttaaaaaatgcccacccactgggtctagggattgaggttattttcctgaattatggctaattatggattacaattcaaggttaaagatacacatatagtattctcaggttattcatatgatagcattttttaagagccaaagtctcagtcacccaggctggagtgcagtggcttgataatggttcgctacagcctccaacttctatgttaaagtgatcctcctacctcagcctttcaaagtgttgggattataggcacgtacctatggccccaaagcactttaacaaatgagtaacagacacagttaaggtagaacctagcattttatttagatcttcattaaactgttggaattgagaaccagacatacgtaataaacctccaaaaatagatcctgaaaggcactttctgcttagggcaagcagtcatggaataagcatgtaaacaagctggcttctctgtaccacaccagccaagtcagctttctccatggccagccgcaccagctctgccctcccttctgttaacaccagccagaccccctgtaggtctaacccaaggtttttctgtaggacaccttggcctacctgggaatgctggaaacatgttgttaaaggaatcatggtgttgagagaaaaaaaaaaaatcttttaaaagctgccatctgaggtgatggcttctctgtacttacgccataccccagaatacaataaataagcaattagaaaacgttcaagtatgaagggatttcctcctccccgccaaaagcactgctctctgaaggaagctggtttctctgtagctacaccagctgttcagaaagctcattggacctggttttgaaaataaaacaaagttaaaa

SEQ ID NO: 136472 - DNA, 1339 bp, Homo sapiens
  Payload ID: 6703
  Gene Symbol: GGCX
  Gene Name: gamma-glutamyl carboxylase
  ENST ID: ENST00000423570
  CDS Start-End: 46-417
gttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatggaaactgggcctgtggtgatctcttgacctcttaatcctctccctacaaatcccaggggcactgggcatgatgctgggcctgtgctaccggataagctgtgtgttattcctgctgccatactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaagtgagtggcagtcatggtggaggcctctttgaggcatgggtacagagcaggtgactcatctctctcagtaatggcacctgttcctactttgcctgaatttgccacatgccttcctttgtccactcatttccctattcagcagaagcagagtcagtggtatcaaaagattgagccctagctgctcttgggagatatatggtatagataggcaagaaaggaaaagaaatttaaaaaggaaaggaaagagccggaactggctgacttggtgagtgagccagtgccctcagcagctgccttggatggtgcctgtgtccttgccttgccactctagcctcccatcagagccctgcagctgatgtactgagaagatgggcactcactgttcaggctctgacaaaaccattattatcacttccacaaaacaaagggtcacctttctgatttgtcttcttcccatttcttctttcctcttgttttactttattctctttcttcttccctgttattttccagttcctgaagtttgacttcattatgatgttagccaagcattcaccttttaaagtgtcctctcactcatgacctccgtggggaacgtcccttccacaacacacacacatctcagtcaaattttgtccta

SEQ ID NO: 136473 - DNA, 533 bp, Homo sapiens
  Payload ID: 6703
  Gene Symbol: GGCX
  Gene Name: gamma-glutamyl carboxylase
  ENST ID: ENST00000428479
  CDS Start-End: 66-287
aaattctcctggcggcctccgttcagacgcggcagctgtgacccacctgcctcctccgcagagcaatggcggtgtctgccgggtccgcgcggacctcgcccagctcagggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctggggaaactgggcctgtggtgatctcttgacctcttaatcctctccctacaaatcccaggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccac

SEQ ID NO: 136474 - DNA, 540 bp, Homo sapiens
  Payload ID: 6703
  Gene Symbol: GGCX
  Gene Name: gamma-glutamyl carboxylase
  ENST ID: ENST00000421496
  CDS Start-End: 66-266
aaattctcctggcggcctccgttcagacgcggcagctgtgacccacctgcctcctccgcagagcaatggcggtgtctgccgggtccgcgcggacctcgcccagctcagggttcttgatggtgctagacattccccaggagcgggggctcagctctctggaccggaaataccttgatgggctggatgtgtgccgcttccccttgctggatgccctacgcccactgccacttgactggatggaaactgggcctgtggtgatctcttgacctcttaatcctctccctacaaatcccaggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccag

SEQ ID NO: 136475 - DNA, 2314 bp, Homo sapiens
  Payload ID: 6703
  Gene Symbol: GGCX
  Gene Name: gamma-glutamyl carboxylase
  Uniprot ID: P38435
  ENST ID: ENST00000430215
  CDS Start-End: 105-2210
acagccgctgacgcgtcgggaggcggagcctagggaagcaaattctcctggcggcctccgttcagacgcggcagctgtgacccacctgcctcctccgcagagcaatggcggtgtctgccgggtccgcgcggacctcgcccagctcagggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttt

SEQ ID NO: 136476 - DNA, 1607 bp, Homo sapiens
  Payload ID: 6704
  Gene Symbol: GGH
  Gene Name: gamma-glutamyl hydrolase (conjugase, folylpolygammaglutamyl hydrolase)
  Uniprot ID: Q92820
  ENST ID: ENST00000260118
  CDS Start-End: 404-1360
tcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaa

SEQ ID NO: 136477 - DNA, 2804 bp, Homo sapiens
  Payload ID: 6705
  Gene Symbol: GGACT
  Gene Name: gamma-glutamylamine cyclotransferase
  Uniprot ID: Q9BVM4
  ENST ID: ENST00000376250
  CDS Start-End: 396-857
gactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagtctgtggcccagacccaggcaagtggtaaatatttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaagtgttggtactgtgtttgacccccacgttttttggtatacttatttggtagaaggttctttacattctgatctagcaaaataatgaacacccacttgctggtagacacagctgagcgcccggacttcaagtggaagtttatctgagcccagatctcagtagccagaccccgtccctgccccctgaagggagagcatttgggggtgagtcctttcaaagaagagccaatgcattagtaatttgttcttcaggcctgacagaagcttagcttccaaatacaaacagcacttaaaataattttagcaaggcacgaagtaccaattactacccacctccatctgataattgtcagcatcgattcaactcggtgcacggctcttgcttctgcttcccagcaaagtctgaaatgtattccaaggatttcagaaccaaatgaaaatgcagctgctgtgatctttagtaacctcattctctgttgggagagctcacttactcttcaacttaatggcagactgtgatcgctaactgcatctggcacaaaaacatgatcattatttttagcttcttttgcttaattggaaacttgcttcacaaaaaacacaaaaaggctacgctgggtctcagctgatgagctcgtggcggccctgtgcttgatgagggcggtgaggcagcccaagctccttgtgactgccctggcttgtgcaatggggaagggaccaggcagcgcgctcatcctcaaaacaaacaaaaacagtggagacagcacccccggccaaccaggaagcttcagggtgacctccaggggagtcagccaccaacagtacacccacatagagacacagcaggaaagggattgccaaaatctgcatttgcagtctctggtccttaggaagttttgaaaatcagcaccaggagtgagggcctcacttctagaagtagtaaggcaatcagatgaaaaaatggcaagtgctaatttaataaagcaaggcagagaactgactgacatttatatcaatctcttaaaaggatcacaaagaaatgctggtagtctactggcagagcctgtcgcctatgtgtacattgtcttcattcaaagaaagggcaaactaatatttagacaaatgctcagttttattgatttaattttgacactagggaatctcacagcagaagtacaaatcatatgtacaagtatttatatcaatgaaaatttccattggtgattttttggcagaatattggtcttgactctgtggaataaatgacgacgtaaacgtagctgcacaggggtgttcctgtataatgcttgaatcaattgtgtgtgaaagcatcatgcaaatggctaattaaattgggtgatgactg

SEQ ID NO: 136478 - DNA, 2678 bp, Homo sapiens
  Payload ID: 6705
  Gene Symbol: GGACT
  Gene Name: gamma-glutamylamine cyclotransferase
  Uniprot ID: Q9BVM4
  ENST ID: ENST00000455100
  CDS Start-End: 251-712
acaaatcacttctgtctttatgtaacagtctgtggcccagacccaggcaagtggtaaatatttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaagtgttggtactgtgtttgacccccacgttttttggtatacttatttggtagaaggttctttacattctgatctagcaaaataatgaacacccacttgctggtagacacagctgagcgcccggacttcaagtggaagtttatctgagcccagatctcagtagccagaccccgtccctgccccctgaagggagagcatttgggggtgagtcctttcaaagaagagccaatgcattagtaatttgttcttcaggcctgacagaagcttagcttccaaatacaaacagcacttaaaataattttagcaaggcacgaagtaccaattactacccacctccatctgataattgtcagcatcgattcaactcggtgcacggctcttgcttctgcttcccagcaaagtctgaaatgtattccaaggatttcagaaccaaatgaaaatgcagctgctgtgatctttagtaacctcattctctgttgggagagctcacttactcttcaacttaatggcagactgtgatcgctaactgcatctggcacaaaaacatgatcattatttttagcttcttttgcttaattggaaacttgcttcacaaaaaacacaaaaaggctacgctgggtctcagctgatgagctcgtggcggccctgtgcttgatgagggcggtgaggcagcccaagctccttgtgactgccctggcttgtgcaatggggaagggaccaggcagcgcgctcatcctcaaaacaaacaaaaacagtggagacagcacccccggccaaccaggaagcttcagggtgacctccaggggagtcagccaccaacagtacacccacatagagacacagcaggaaagggattgccaaaatctgcatttgcagtctctggtccttaggaagttttgaaaatcagcaccaggagtgagggcctcacttctagaagtagtaaggcaatcagatgaaaaaatggcaagtgctaatttaataaagcaaggcagagaactgactgacatttatatcaatctcttaaaaggatcacaaagaaatgctggtagtctactggcagagcctgtcgcctatgtgtacattgtcttcattcaaagaaagggcaaactaatatttagacaaatgctcagttttattgatttaattttgacactagggaatctcacagcagaagtacaaatcatatgtacaagtatttatatcaatgaaaatttccattggtgattttttggcagaatattggtcttgactctgtggaataaatgacgacgtaaacgtagctgcacaggggtgttcctgtataatgcttgaatcaattgtgtgtgaaagcatcatgcaaatggctaattaaattgggtgatgactgaaaggttataaatccttca

SEQ ID NO: 136479 - DNA, 455 bp, Homo sapiens
  Payload ID: 6705
  Gene Symbol: GGACT
  Gene Name: gamma-glutamylamine cyclotransferase
  ENST ID: ENST00000464500
  CDS Start-End: 378-455
gtgtgggtgctgagctccgctgcgtcagactgccaggacctgagtggaactcagtgctgaaacctgggttctcactgcagctggatagcaggtggttacaaaattatatgtatttttagggttatttctaatttttctttaatagttattggcaattttcaaagtcctttaagaaacactgaaaactgctcaagaaaatggcagttctgcagggctcaggtagcagggcaggctgttgggacaggtttgacagactgtcctaatacaaggagcgccttttcccagatcagcagctctagagggtggcggccttgcctggaacctccgcaacctccgcgcccaccacacaagggctgagaacagtaagctctgcccggatggccctagtcttcgtgtacggcaccctgaagcggggtcagcccaaccacagggtcctgcgggacggcgcccacggc

SEQ ID NO: 136480 - DNA, 498 bp, Homo sapiens
  Payload ID: 6705
  Gene Symbol: GGACT
  Gene Name: gamma-glutamylamine cyclotransferase
  ENST ID: ENST00000492399
  CDS Start-End: 402-498
gagacagaagtgtcactctctccatagctgtaccattcctaccacctggcccccaagtggcattgctttaacccattgtctctagggaaaatgttctctttcgattttggttctcagtcctataatttctggggcttaaattagtcctggagctagggaagaggtgatgtcatccttccattgtctccttcggccacagtttcattttaagagtattggactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagctctgcccggatggccctagtcttcgtgtacggcaccctgaagcggggtcagcccaaccacagggtcctgcgggacggcgcccacggctccgcagcctttcgggcgc

SEQ ID NO: 136481 - DNA, 393 bp, Homo sapiens
  Payload ID: 6705
  Gene Symbol: GGACT
  Gene Name: gamma-glutamylamine cyclotransferase
  ENST ID: ENST00000471912
  CDS Start-End: 316-393
tgagcccgggcgggggtcggggctgcgcctgctccgccccccaggcggggtgtcctggcgcccgcgggaacctggggcgtcgctccctgcgcggcgtccgggtcgaggccgcagcactcggcgtccccgcgggactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagctctgcccggatggccctagtcttcgtgtacggcaccctgaagcggggtcagcccaaccacagggtcctgcgggacggcgcccacggc

SEQ ID NO: 136482 - DNA, 296 bp, Homo sapiens
  Payload ID: 6705
  Gene Symbol: GGACT
  Gene Name: gamma-glutamylamine cyclotransferase
  ENST ID: ENST00000467518
  CDS Start-End: 200-296
ggggaaacaccagaaggtgtgggtgctgagctccgctgcgtcagactgccaggacctgagtggaactcagtgctgaaacctgggttctcactgcagctggatagcagatcagcagctctagagggtggcggccttgcctggaacctccgcaacctccgcgcccaccacacaagggctgagaacagtaagctctgcccggatggccctagtcttcgtgtacggcaccctgaagcggggtcagcccaaccacagggtcctgcgggacggcgcccacggctccgcagcctttcgggcgc

SEQ ID NO: 136483 - DNA, 1032 bp, Homo sapiens
  Payload ID: 6706
  Gene Symbol: GGCT
  Gene Name: gamma-glutamylcyclotransferase
  Uniprot ID: O75223
  ENST ID: ENST00000005374
  CDS Start-End: 133-477
cttcccgccagtcccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgaattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggttt

SEQ ID NO: 136484 - DNA, 1173 bp, Homo sapiens
  Payload ID: 6706
  Gene Symbol: GGCT
  Gene Name: gamma-glutamylcyclotransferase
  Uniprot ID: O75223
  ENST ID: ENST00000275428
  CDS Start-End: 136-702
acgcttcccgccagtcccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaa

SEQ ID NO: 136485 - DNA, 836 bp, Homo sapiens
  Payload ID: 6706
  Gene Symbol: GGCT
  Gene Name: gamma-glutamylcyclotransferase
  Uniprot ID: O75223
  ENST ID: ENST00000409144
  CDS Start-End: 93-377
gtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgta

SEQ ID NO: 136486 - DNA, 954 bp, Homo sapiens
  Payload ID: 6706
  Gene Symbol: GGCT
  Gene Name: gamma-glutamylcyclotransferase
  ENST ID: ENST00000409436
  CDS Start-End: 108-608
ggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaataggtaatctggttcctaggcctcgtttggaattttttagtatgaaacctagagaaattagcctggtatagattatgaaagtaccgctaaacacagttgccatttattcccccatgtccaattcagagcaagggtaacctctggcgttgtaaccgaaactgctctctgtaaactttaaattttttttgaagaatggtattttttttcttaaaaggtcatataaattttatatagatatgtttgtcttaatattaaaatatttaaaatcata

SEQ ID NO: 136487 - DNA, 767 bp, Homo sapiens
  Payload ID: 6706
  Gene Symbol: GGCT
  Gene Name: gamma-glutamylcyclotransferase
  Uniprot ID: O75223
  ENST ID: ENST00000409390
  CDS Start-End: 91-591
cactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtt

SEQ ID NO: 136488 - DNA, 784 bp, Homo sapiens
  Payload ID: 6706
  Gene Symbol: GGCT
  Gene Name: gamma-glutamylcyclotransferase
  ENST ID: ENST00000447901
  CDS Start-End: 93-248
gtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctga

SEQ ID NO: 136489 - DNA, 889 bp, Homo sapiens
  Payload ID: 6706
  Gene Symbol: GGCT
  Gene Name: gamma-glutamylcyclotransferase
  ENST ID: ENST00000426081
  CDS Start-End: 1-359
attttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagataga

SEQ ID NO: 136490 - DNA, 1012 bp, Homo sapiens
  Payload ID: 6706
  Gene Symbol: GGCT
  Gene Name: gamma-glutamylcyclotransferase
  ENST ID: ENST00000440082
  CDS Start-End: 121-276
cccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaa

SEQ ID NO: 136491 - DNA, 2326 bp, Homo sapiens
  Payload ID: 6707
  Gene Symbol: GGT1
  Gene Name: gamma-glutamyltransferase 1
  Uniprot ID: P19440
  ENST ID: ENST00000248923
  CDS Start-End: 488-2197
gcctggattctcccagagattgcctggaacaccagctcgggtcctcgcacaccatcctgcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgcc

SEQ ID NO: 136492 - DNA, 2540 bp, Homo sapiens
  Payload ID: 6707
  Gene Symbol: GGT1
  Gene Name: gamma-glutamyltransferase 1
  Uniprot ID: P19440
  ENST ID: ENST00000400380
  CDS Start-End: 669-2378
cagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctcccc

SEQ ID NO: 136493 - DNA, 2628 bp, Homo sapiens
  Payload ID: 6707
  Gene Symbol: GGT1
  Gene Name: gamma-glutamyltransferase 1
  Uniprot ID: P19440
  ENST ID: ENST00000400382
  CDS Start-End: 756-2465
gtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctcccca

SEQ ID NO: 136494 - DNA, 968 bp, Homo sapiens
  Payload ID: 6707
  Gene Symbol: GGT1
  Gene Name: gamma-glutamyltransferase 1
  Uniprot ID: P19440
  ENST ID: ENST00000401885
  CDS Start-End: 134-811
attgaatgcagcaagggtctggaggctgaggaccaggcagacagacattcagagttgctggaacgcgacagagacagggagtcagactggtcatgcaaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtc

SEQ ID NO: 136495 - DNA, 1033 bp, Homo sapiens
  Payload ID: 6707
  Gene Symbol: GGT1
  Gene Name: gamma-glutamyltransferase 1
  Uniprot ID: P19440
  ENST ID: ENST00000403838
  CDS Start-End: 190-867
agggagtcagactggtcatgcaaggtcctgggcctgcccttgggtcctggggagccacggaaggttgtgggtgccagagggttgcggtcagagtcacagtcaagggccttctgagacctgtgccccctccccaccctccctccccacctcctcaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactc

SEQ ID NO: 136496 - DNA, 657 bp, Homo sapiens
  Payload ID: 6707
  Gene Symbol: GGT1
  Gene Name: gamma-glutamyltransferase 1
  ENST ID: ENST00000404920
  CDS Start-End: 1-657
atgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 136497 - DNA, 952 bp, Homo sapiens
  Payload ID: 6707
  Gene Symbol: GGT1
  Gene Name: gamma-glutamyltransferase 1
  ENST ID: ENST00000404223
  CDS Start-End: 37-795
aggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggtatgtgtcacaccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtc

SEQ ID NO: 136498 - DNA, 853 bp, Homo sapiens
  Payload ID: 6707
  Gene Symbol: GGT1
  Gene Name: gamma-glutamyltransferase 1
  Uniprot ID: P19440
  ENST ID: ENST00000404532
  CDS Start-End: 40-717
gacagggagtcagactggtcatgcaaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctcc

SEQ ID NO: 136499 - DNA, 2632 bp, Homo sapiens
  Payload ID: 6707
  Gene Symbol: GGT1
  Gene Name: gamma-glutamyltransferase 1
  Uniprot ID: P19440
  ENST ID: ENST00000425895
  CDS Start-End: 744-1844
ggcccaccaagcctggggaggtggccacccttccatgatggcatttggatgttccctgtgtgtggggagggcacagggactccattcgtagaccacctctgggacagtgtgtctgcctctgaggtcagacgctctgcactgggacagggtggagtggagggaaatccagcttggggctcattggaggggcttgctggcagacaccgccctttgtgggaaactgactgtgggagaggggaaccccaacctctgtcaccacatccctcttccctgttgtcacacctgtcacctgctgccatagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtc

SEQ ID NO: 136500 - DNA, 853 bp, Homo sapiens
  Payload ID: 6707
  Gene Symbol: GGT1
  Gene Name: gamma-glutamyltransferase 1
  ENST ID: ENST00000451366
  CDS Start-End: 506-853
cctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgcc

SEQ ID NO: 136501 - DNA, 758 bp, Homo sapiens
  Payload ID: 6707
  Gene Symbol: GGT1
  Gene Name: gamma-glutamyltransferase 1
  ENST ID: ENST00000411974
  CDS Start-End: 397-758
ggtcagagctttaagctgcagctctgatgccccagggacctctcagacccccctgcccagagcaggcagcccgcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacag

SEQ ID NO: 136502 - DNA, 606 bp, Homo sapiens
  Payload ID: 6707
  Gene Symbol: GGT1
  Gene Name: gamma-glutamyltransferase 1
  ENST ID: ENST00000445029
  CDS Start-End: 404-606
cttagcttggttttggtgtgctgctggatgaccagaccgggcgtcgggtgagcccagaagtgagagcagttggctgtgccccagtgctgtgtgacccagaggcgccgctcaccctctctgagctggtggacatcataggtggggaagctcagcgggtgcagcccagaactgtcttctgaggaagaggtgctctcctgggcccccactgtccccaggcctcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagc

SEQ ID NO: 136503 - DNA, 2091 bp, Homo sapiens
  Payload ID: 6707
  Gene Symbol: GGT1
  Gene Name: gamma-glutamyltransferase 1
  ENST ID: ENST00000412658
  CDS Start-End: 702-2091
aggggagggaaggaggagctgggtcacagcagggaatcttagcttggttttggtgtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggcc

SEQ ID NO: 136504 - DNA, 1078 bp, Homo sapiens
  Payload ID: 6707
  Gene Symbol: GGT1
  Gene Name: gamma-glutamyltransferase 1
  ENST ID: ENST00000419133
  CDS Start-End: 556-1078
ggtgtgctgctggatgaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttgg

SEQ ID NO: 136505 - DNA, 747 bp, Homo sapiens
  Payload ID: 6707
  Gene Symbol: GGT1
  Gene Name: gamma-glutamyltransferase 1
  ENST ID: ENST00000432867
  CDS Start-End: 415-747
tccgtgagaggcctgcctgtcctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggccccc

SEQ ID NO: 136506 - DNA, 743 bp, Homo sapiens
  Payload ID: 6707
  Gene Symbol: GGT1
  Gene Name: gamma-glutamyltransferase 1
  ENST ID: ENST00000447416
  CDS Start-End: 364-743
tcccagccaggctggacctccgtgagaggcctgcctgtcctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaa

SEQ ID NO: 136507 - DNA, 537 bp, Homo sapiens
  Payload ID: 6707
  Gene Symbol: GGT1
  Gene Name: gamma-glutamyltransferase 1
  ENST ID: ENST00000438643
  CDS Start-End: 427-537
gaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtg

SEQ ID NO: 136508 - DNA, 831 bp, Homo sapiens
  Payload ID: 6707
  Gene Symbol: GGT1
  Gene Name: gamma-glutamyltransferase 1
  ENST ID: ENST00000412898
  CDS Start-End: 592-831
ccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcc

SEQ ID NO: 136509 - DNA, 579 bp, Homo sapiens
  Payload ID: 6707
  Gene Symbol: GGT1
  Gene Name: gamma-glutamyltransferase 1
  ENST ID: ENST00000455483
  CDS Start-End: 287-579
agaccgggcgtcgggtgagcccagaagtgagagcagttggctgtgccccagtgctgtgtgacccagaggcgccgctcaccctctctgagctggtggacatcataggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccac

SEQ ID NO: 136510 - DNA, 874 bp, Homo sapiens
  Payload ID: 6707
  Gene Symbol: GGT1
  Gene Name: gamma-glutamyltransferase 1
  ENST ID: ENST00000428855
  CDS Start-End: 495-874
accctgtgcagatgcctcccactgtccgccggggctgctgggcacgccctggctggtctcttggactagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaa

SEQ ID NO: 136511 - DNA, 597 bp, Homo sapiens
  Payload ID: 6707
  Gene Symbol: GGT1
  Gene Name: gamma-glutamyltransferase 1
  ENST ID: ENST00000456869
  CDS Start-End: 508-597
cccggtcagagctttaagctgcagctctgatgccccagggacctctcagacccccctgcccagagcaggcagcccgcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctcc

SEQ ID NO: 136512 - DNA, 811 bp, Homo sapiens
  Payload ID: 6707
  Gene Symbol: GGT1
  Gene Name: gamma-glutamyltransferase 1
  ENST ID: ENST00000452551
  CDS Start-End: 430-811
gaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagg

SEQ ID NO: 136513 - DNA, 929 bp, Homo sapiens
  Payload ID: 6707
  Gene Symbol: GGT1
  Gene Name: gamma-glutamyltransferase 1
  ENST ID: ENST00000430289
  CDS Start-End: 604-929
gcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggt

SEQ ID NO: 136514 - DNA, 1845 bp, Homo sapiens
  Payload ID: 6708
  Gene Symbol: GGT2
  Gene Name: gamma-glutamyltransferase 2
  ENST ID: ENST00000405188
  CDS Start-End: 1-1680
atgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaagggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctatgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccact

SEQ ID NO: 136515 - DNA, 2366 bp, Homo sapiens
  Payload ID: 6708
  Gene Symbol: GGT2
  Gene Name: gamma-glutamyltransferase 2
  Uniprot ID: P36268
  ENST ID: ENST00000401924
  CDS Start-End: 493-2202
atgctgcatattgctggcccagctcctgaggctctttggacctccaggaatcggtgtctctaccaggaacccttaaccctgacccggactcccggctgggacccggggtgttggagtggcaagagcgctgtcaggcctggtgaagggtgtgagctgtccaacagggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtctctgaagaagattctgtggctacaggcttcagcagagtgtgagggagaccccggttatttcctcagctgtttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaagggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccac

SEQ ID NO: 136516 - DNA, 1871 bp, Homo sapiens
  Payload ID: 6708
  Gene Symbol: GGT2
  Gene Name: gamma-glutamyltransferase 2
  Uniprot ID: P36268
  ENST ID: ENST00000424627
  CDS Start-End: 63-1772
tctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaagggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagca

SEQ ID NO: 136517 - DNA, 2334 bp, Homo sapiens
  Payload ID: 6709
  Gene Symbol: GGT5
  Gene Name: gamma-glutamyltransferase 5
  Uniprot ID: P36269
  ENST ID: ENST00000263112
  CDS Start-End: 354-2018
actccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctga

SEQ ID NO: 136518 - DNA, 2494 bp, Homo sapiens
  Payload ID: 6709
  Gene Symbol: GGT5
  Gene Name: gamma-glutamyltransferase 5
  Uniprot ID: P36269
  ENST ID: ENST00000327365
  CDS Start-End: 418-2178
tgcctggcctcctgccagcaacaagcaggagctgaaaaccagaagttgaggcgtgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctga

SEQ ID NO: 136519 - DNA, 2408 bp, Homo sapiens
  Payload ID: 6709
  Gene Symbol: GGT5
  Gene Name: gamma-glutamyltransferase 5
  Uniprot ID: P36269
  ENST ID: ENST00000398292
  CDS Start-End: 335-2098
gtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgcagtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtg

SEQ ID NO: 136520 - DNA, 972 bp, Homo sapiens
  Payload ID: 6709
  Gene Symbol: GGT5
  Gene Name: gamma-glutamyltransferase 5
  ENST ID: ENST00000425408
  CDS Start-End: 1-662
gcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccagaaacaggatcttgctgcattgcccaggctggtctcaaactcctggcctcaagtgatcctccttcctcagcctcccaaattgctggcattacaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtg

SEQ ID NO: 136521 - DNA, 576 bp, Homo sapiens
  Payload ID: 6709
  Gene Symbol: GGT5
  Gene Name: gamma-glutamyltransferase 5
  ENST ID: ENST00000424217
  CDS Start-End: 358-576
ggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacggggcccagtggatcggggtgcccggggagctccgtggctatgccga

SEQ ID NO: 136522 - DNA, 2534 bp, Homo sapiens
  Payload ID: 6710
  Gene Symbol: GGT6
  Gene Name: gamma-glutamyltransferase 6
  Uniprot ID: Q6P531
  ENST ID: ENST00000301395
  CDS Start-End: 61-1446
ctctgagacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaaccaa

SEQ ID NO: 136523 - DNA, 2145 bp, Homo sapiens
  Payload ID: 6710
  Gene Symbol: GGT6
  Gene Name: gamma-glutamyltransferase 6
  ENST ID: ENST00000381550
  CDS Start-End: 56-1555
agacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcagccacatgctcccacctaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggca

SEQ ID NO: 136524 - DNA, 2482 bp, Homo sapiens
  Payload ID: 6710
  Gene Symbol: GGT6
  Gene Name: gamma-glutamyltransferase 6
  Uniprot ID: Q6P531
  ENST ID: ENST00000574154
  CDS Start-End: 298-1779
agtatcaaggttgtggcattaaggctgaactccttctcgacctcactgagctgtggccccttacaggcagtcaccccgggaaccctgtcgcgagagctcctcgggccttgtgtcctaatggggcaggctcacatgcagcctccttggccccgtgccctgcccagacctgttctggattccacccccacccttccccaaggtcgctgccacctcccacctgccaggcttgggcagggcctctgagacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaa

SEQ ID NO: 136525 - DNA, 583 bp, Homo sapiens
  Payload ID: 6710
  Gene Symbol: GGT6
  Gene Name: gamma-glutamyltransferase 6
  ENST ID: ENST00000574584
  CDS Start-End: 44-583
aaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctagactgctgtgagccccgagagcagtgccctggccgccgtggacagcagcggctctgtgctccttctcacctcctcgctcaactgctcctttggctctgcaca

SEQ ID NO: 136526 - DNA, 1730 bp, Homo sapiens
  Payload ID: 6710
  Gene Symbol: GGT6
  Gene Name: gamma-glutamyltransferase 6
  ENST ID: ENST00000573591
  CDS Start-End: 498-1535
tttcccatccccatgtctgcccaagatgcacccgctgccaagaagccctttctccttggctgacttgtgctcctcttgctaaatcaaaccttttgggaaatattccctggggtctcttggggtccttgggcatccctctgtcccagccgtggctcaggacaccccccctctgcaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcagccacatgctcccacctaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaag

SEQ ID NO: 136527 - DNA, 2642 bp, Homo sapiens
  Payload ID: 6711
  Gene Symbol: GGT7
  Gene Name: gamma-glutamyltransferase 7
  Uniprot ID: Q9UJ14
  ENST ID: ENST00000336431
  CDS Start-End: 46-2034
agccacttccggcaggcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgccacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaa

SEQ ID NO: 136528 - DNA, 615 bp, Homo sapiens
  Payload ID: 6711
  Gene Symbol: GGT7
  Gene Name: gamma-glutamyltransferase 7
  ENST ID: ENST00000427420
  CDS Start-End: 8-615
ggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgccgggcaccgttgccccgcctgtcctggggtgcacgcgaaaatgaggaaagacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcgg

SEQ ID NO: 136529 - DNA, 427 bp, Homo sapiens
  Payload ID: 6711
  Gene Symbol: GGT7
  Gene Name: gamma-glutamyltransferase 7
  ENST ID: ENST00000470952
  CDS Start-End: 1-265
ctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacc

SEQ ID NO: 136530 - DNA, 1064 bp, Homo sapiens
  Payload ID: 6711
  Gene Symbol: GGT7
  Gene Name: gamma-glutamyltransferase 7
  ENST ID: ENST00000469018
  CDS Start-End: 1-454
cccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgag

SEQ ID NO: 136531 - DNA, 974 bp, Homo sapiens
  Payload ID: 6712
  Gene Symbol: GGTLC1
  Gene Name: gamma-glutamyltransferase light chain 1
  Uniprot ID: Q9BX51
  ENST ID: ENST00000278765
  CDS Start-End: 134-811
attgaatgcagcaagggtctggaggctgaggaccaggcagacaaacattcagagttgctggaatgcgacagagacagggagtcagactggtcatgcaaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccca

SEQ ID NO: 136532 - DNA, 1028 bp, Homo sapiens
  Payload ID: 6712
  Gene Symbol: GGTLC1
  Gene Name: gamma-glutamyltransferase light chain 1
  Uniprot ID: Q9BX51
  ENST ID: ENST00000286890
  CDS Start-End: 185-862
gtcagactggtcatgcaaggtcctgggcctgcccttgggtcctggggagccacggaaggttgtgggtgccagagggttgtggtcagagccacagtcaggggccttctgagacctgtgccccctccccaccctccctccccacctccctaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 136533 - DNA, 1046 bp, Homo sapiens
  Payload ID: 6712
  Gene Symbol: GGTLC1
  Gene Name: gamma-glutamyltransferase light chain 1
  Uniprot ID: Q9BX51
  ENST ID: ENST00000335694
  CDS Start-End: 206-883
ctcgagagctgggctctgcgtcctcgtccagccgccaactcggccaaaggcgaagccagcagtttcttctgctgccgggcaacgcgccttttaaacctgagggagtgggcgcgtgagcacttaatggcgccggtgacagagtgagcttaacggattaataagcgcagccaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccca

SEQ ID NO: 136534 - DNA, 678 bp, Homo sapiens
  Payload ID: 6713
  Gene Symbol: GGTLC2
  Gene Name: gamma-glutamyltransferase light chain 2
  ENST ID: ENST00000448514
  CDS Start-End: 1-678
atgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccaggtccggatggtggtgggagctgctgggggcacacagatcaccacagccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 136535 - DNA, 657 bp, Homo sapiens
  Payload ID: 6713
  Gene Symbol: GGTLC2
  Gene Name: gamma-glutamyltransferase light chain 2
  Uniprot ID: Q14390
  ENST ID: ENST00000480559
  CDS Start-End: 1-657
atgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 136536 - DNA, 973 bp, Homo sapiens
  Payload ID: 6713
  Gene Symbol: GGTLC2
  Gene Name: gamma-glutamyltransferase light chain 2
  ENST ID: ENST00000613850
  CDS Start-End: 134-811
attgaatgcagcaagggtctggaggctgaggaccaggcagacagacattcagagttgctggaatgcgacagagacagggagtcagactggtcatgcaaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccaggtccggatggtggtgggagctgctgggggcacacagatcaccacagccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctcccc

SEQ ID NO: 136537 - DNA, 1047 bp, Homo sapiens
  Payload ID: 6713
  Gene Symbol: GGTLC2
  Gene Name: gamma-glutamyltransferase light chain 2
  ENST ID: ENST00000618722
  CDS Start-End: 208-885
ctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagcgagcttaacggattaataagcgcagccaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccaggtccggatggtggtgggagctgctgggggcacacagatcaccacagccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctcccc

SEQ ID NO: 136538 - DNA, 968 bp, Homo sapiens
  Payload ID: 6714
  Gene Symbol: GGTLC3
  Gene Name: gamma-glutamyltransferase light chain 3
  Uniprot ID: B5MD39
  ENST ID: ENST00000619998
  CDS Start-End: 134-811
attgaatgcggcaagggtctggaggctgaggaccaggcagacagacattcagagttgctggaacgcgacagagacagggagtcagactggtcatgcaaggccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcccgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcatccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtc

SEQ ID NO: 136539 - DNA, 3251 bp, Homo sapiens
  Payload ID: 6715
  Gene Symbol: GSAP
  Gene Name: gamma-secretase activating protein
  Uniprot ID: A4D1B5
  ENST ID: ENST00000257626
  CDS Start-End: 80-2644
cgagggcgaggcggccacgcggggccgggaatgcccgcggtgcggggccccagagccgcccggtggtcgtgtccgggcgatggctcttcgcctggtcgccgacttcgacctcgggaaggacgtgctcccgtggttgcgggcgcagcgggcagtgtcggaggccagcggggccggaagcggcggcgcagatgttttagaaaacgattatgagagcttacatgtattaaatgttgaaagaaatggaaatattatttatacctataaggatgataagggaaatgtcgtctttggattatatgattgtcaaaccagacaaaatgagcttctatatacctttgagaaagacttgcaagttttcagttgctctgtcaacagtgaaaggactttgcttgctgcaagtttagttcagtctactaaagaaggaaaaaggaacgaacttcaaccaggatcaaagtgcttgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaaggtgatttctaacctagaagcaagaaatttggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 136540 - DNA, 564 bp, Homo sapiens
  Payload ID: 6715
  Gene Symbol: GSAP
  Gene Name: gamma-secretase activating protein
  ENST ID: ENST00000415112
  CDS Start-End: 1-564
gtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaaggtgatttctaacctagaagcaagaaatttggggccaagattaacacccctcctgcaggaggaagacagccaccagcggctgctcatggggctgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatg

SEQ ID NO: 136541 - DNA, 600 bp, Homo sapiens
  Payload ID: 6715
  Gene Symbol: GSAP
  Gene Name: gamma-secretase activating protein
  ENST ID: ENST00000430584
  CDS Start-End: 401-577
gcatcccacctcccggggggttcatcggcagcgcaggggctttgccaagacaggagtgctcctggaagcttcacgttttgagaaagaatccgtgaccaccaagcaaaccaccctatacctaacggtggaacagtttgtccccacatttgcgagacgtgtttatgtgtctgttgaaccgtgtccgtggctcaggggacatgggcctcggcggtgaggcgcaagagggcaggggccgcctccaggctgcgcgcggcggggcgagagcccccagccgcccccgagctccgcacctgtgcaggctggggctgcgcgcgagatgctcggctcccggccctgccactccgggctttttgatgatttgatgttttagaaaacgattatgagagcttacatgtattaaatgttgaaagaaatggaaatattatttatacctataaggatgataagggaaatgtcgtctttggattatatgattgtcaaaccagacaaaatgagcttctatatacctttgagaaagacttgcaagttttcagttgctctgtcaacagtgaaaggactttgcttgctgcaagtttagttcagtctactaaagaaggaaaa

SEQ ID NO: 136542 - DNA, 737 bp, Homo sapiens
  Payload ID: 6715
  Gene Symbol: GSAP
  Gene Name: gamma-secretase activating protein
  ENST ID: ENST00000441833
  CDS Start-End: 175-702
aggaagacagccaccagcggctgctcatggggctgatggtgtctgagctaaaagaccattttttgagacacctacagggtgtagaaaagaagaaaattgaacagatggttctggactacatttcaaaactgcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattt

SEQ ID NO: 136543 - DNA, 3666 bp, Homo sapiens
  Payload ID: 6716
  Gene Symbol: GDAP1
  Gene Name: ganglioside induced differentiation associated protein 1
  Uniprot ID: Q8TB36
  ENST ID: ENST00000220822
  CDS Start-End: 81-1157
ggaaacgccttgcggggcagtgtgggagggagaagtccagggcggacaggctgggcgcacccgtgctcgcgcaccccaagatggctgagaggcaggaagagcagagagggagcccgcccttgagggcggaaggcaaggccgacgcggaggttaagctcattctgtaccattggacgcattccttcagctctcaaaaggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctaggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaaccctaaaacaaa

SEQ ID NO: 136544 - DNA, 1228 bp, Homo sapiens
  Payload ID: 6716
  Gene Symbol: GDAP1
  Gene Name: ganglioside induced differentiation associated protein 1
  Uniprot ID: Q8TB36
  ENST ID: ENST00000434412
  CDS Start-End: 119-991
ccagggcggacaggctgggcgcacccgtgctcgcgcaccccaagatggctgagaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaa

SEQ ID NO: 136545 - DNA, 1324 bp, Homo sapiens
  Payload ID: 6716
  Gene Symbol: GDAP1
  Gene Name: ganglioside induced differentiation associated protein 1
  ENST ID: ENST00000522568
  CDS Start-End: 19-201
gtgctcgcgcaccccaagatggctgagaggcaggaagagcagagagggagcccgcccttgagggcggaaggcaaggccgacgcggaggttaagctcattctgtaccattggacgcattccttcagctctcaaaaggtgcgcttggtaattgctgaaaaggcattgaagtgcgaggaacatgataaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaa

SEQ ID NO: 136546 - DNA, 2265 bp, Homo sapiens
  Payload ID: 6717
  Gene Symbol: GDAP1L1
  Gene Name: ganglioside induced differentiation associated protein 1-like 1
  Uniprot ID: Q96MZ0
  ENST ID: ENST00000342560
  CDS Start-End: 89-1192
gcaggctcggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaa

SEQ ID NO: 136547 - DNA, 722 bp, Homo sapiens
  Payload ID: 6717
  Gene Symbol: GDAP1L1
  Gene Name: ganglioside induced differentiation associated protein 1-like 1
  Uniprot ID: Q96MZ0
  ENST ID: ENST00000372952
  CDS Start-End: 3-446
tcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggaccccgcctggcagcaagtctggagctgagaggagctaaccctcggggacagcttggcagagcccagtgaggagagatggccgggccaccactagaatcccctgtccgccagcagccaagcccgagcatgggggtgcccagggcctctgggcagagacatcttggggctcagggatgccgggggcaggtggccggggcaggtgcccctctggcttccctgcccagcccctggcggtgcccacagagcacgtggtggccctgatgcccgaggtgggcagcctgcagcacgcacgggtgctgcagtaccgggagctgctggacgcactgcccatggatgcctacacgc

SEQ ID NO: 136548 - DNA, 538 bp, Homo sapiens
  Payload ID: 6717
  Gene Symbol: GDAP1L1
  Gene Name: ganglioside induced differentiation associated protein 1-like 1
  ENST ID: ENST00000447658
  CDS Start-End: 1-372
ttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtctcaagatggaactgtggagactggttaggatctgagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcatt

SEQ ID NO: 136549 - DNA, 880 bp, Homo sapiens
  Payload ID: 6717
  Gene Symbol: GDAP1L1
  Gene Name: ganglioside induced differentiation associated protein 1-like 1
  ENST ID: ENST00000438466
  CDS Start-End: 16-880
tgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcc

SEQ ID NO: 136550 - DNA, 826 bp, Homo sapiens
  Payload ID: 6717
  Gene Symbol: GDAP1L1
  Gene Name: ganglioside induced differentiation associated protein 1-like 1
  ENST ID: ENST00000445952
  CDS Start-End: 1-754
gtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgagggtgggtgccagccctgggggaggtgggggctgcagcccacccagcctactcttcccctgcccagtctcagcctcttttttccgcaaaagtctcagaggacctcccaggtggttaagaggatgggctatggagtcagactaaggttcaagtcataacttggccacttcctagcttagtaaatgtggtcaggttctcccctctctgaaattcagtttcccatctataaa

SEQ ID NO: 136551 - DNA, 2855 bp, Homo sapiens
  Payload ID: 6717
  Gene Symbol: GDAP1L1
  Gene Name: ganglioside induced differentiation associated protein 1-like 1
  Uniprot ID: Q96MZ0
  ENST ID: ENST00000537864
  CDS Start-End: 78-1238
gaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggtggccggggcaggtgcccctctggcttccctgcccagcccctggcggtgcccacagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctagaaaataaaataaaataaacctatatatggacctcagggggcacccagggcacatgccccccaccccaatttcccagagggaaaaatgtatttaaaatgcccaaagaacattaaatcaggagtataatgtgtagaatataaggcatggttttac

SEQ ID NO: 136552 - DNA, 2645 bp, Homo sapiens
  Payload ID: 6717
  Gene Symbol: GDAP1L1
  Gene Name: ganglioside induced differentiation associated protein 1-like 1
  ENST ID: ENST00000617075
  CDS Start-End: 192-1028
gcagggagcctgacactgagggctggcggcttttctggcgcgggccagggggaggaggagaaaggagctcccgggatcccctcgccccctcccccaactgcccggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctagaaaataaaataaaataaacctatatatggacctcagggggcacccagggcacatgccccccaccccaatttcccagagggaaaaatgtatttaaaatgcccaaagaacattaaatcaggagtataatgtgtagaatataaggcatggttttac

SEQ ID NO: 136553 - DNA, 2585 bp, Homo sapiens
  Payload ID: 6717
  Gene Symbol: GDAP1L1
  Gene Name: ganglioside induced differentiation associated protein 1-like 1
  ENST ID: ENST00000612599
  CDS Start-End: 78-968
gaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcaggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctagaaaataaaataaaataaacctatatatggacctcagggggcacccagggcacatgccccccaccccaatttcccagagggaaaaatgtatttaaaatgcccaaagaacattaaatcaggagtataatgtgtagaatataaggcatggttttac

SEQ ID NO: 136554 - DNA, 1136 bp, Homo sapiens
  Payload ID: 6717
  Gene Symbol: GDAP1L1
  Gene Name: ganglioside induced differentiation associated protein 1-like 1
  ENST ID: ENST00000616372
  CDS Start-End: 17-1111
ctgattccgggctgtcatggcgacccccaacaatctgacccccaccaactgcagctggtggcccatctccgcgctggagagcgatggccaagccagcggaggcccccgacgctcccgaggcggccagcccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctggcacgcacgggtgctgcagtaccggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgagggagctggagaagaggaagctggagaacgaggggcagaaatgcgagctgtggctctgtggctgtgccttcacctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctg

SEQ ID NO: 136555 - DNA, 2436 bp, Homo sapiens
  Payload ID: 6718
  Gene Symbol: GDAP2
  Gene Name: ganglioside induced differentiation associated protein 2
  Uniprot ID: Q9NXN4
  ENST ID: ENST00000369442
  CDS Start-End: 204-1694
actccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaattataatcgctggttatgtcaagcaagatctgaggatctgtctgatattgcttctctaaaagccttataccaaacaggtgttgataactgtggtcgaacagtgatggtggtagttggaagaaacattcctgtaacattaatagatatggacaaggctctcttatatttcattcatgtaatggatcacattgctgtgaaggagtatgtattagtgtattttcacaccctgaccagcgaatacaatcacctggactccgacttcctgaagaaactctacgatgttgttgatgtcaagtacaagaggaatttgaaggctgtttattttgtacatcccacatttcgttcaaaggtgtcaacatggttttttaccaccttttctgtctcaggactgaaggacaaaatccaccatgtggacagcctccaccagctgttttctgccatatcaccagaacagattgactttcctccttttgtccttgaatatgatgccagggtaagaagtaccagaagttctccctcacctggtatggtatattaactgttctatagagcagcacttacgagcacaacatcctgtcattaccagatattaatgtaaattagtgagtcttaataaacttggtaatatcatttaacatactttccctatgataactttaggaaaaggatttgtcccaagagaggcattttctccagataaacgtttcagtgggagatctctctgctgtgagttcagaaccaattttcgtttgtattgtaagttttctaccatatttaaaacagatacctctgcctaattttcttaagattgaatggctttccatctacacagagccagaagaatttattggtgatcacttttagaattaattgcaaatcatgtggcctatctcagtagtctttaccctgctaaaagtttcatttatctaaaaggttgtataatgtttttaagagcatcatctgataatattattgttgttatttatagatgcgtttatggatctgttacataagcactagtcacaggactactcgtgaatttcatcaatttattctattgtgtttattcatgatatcaccttagtaatttttgaaaaaaaaaaagtaacacacttggccaaaagctcatcaagctgattgtttaactgttgctgattgcttatctttatattgtatgaaccaggggatagatttgaaagttatattaagtttgaaatgaattattcttccctaattattgtgcagtgtttatacagcaaaataaaaattctgcaacacaa

SEQ ID NO: 136556 - DNA, 8828 bp, Homo sapiens
  Payload ID: 6718
  Gene Symbol: GDAP2
  Gene Name: ganglioside induced differentiation associated protein 2
  Uniprot ID: Q9NXN4
  ENST ID: ENST00000369443
  CDS Start-End: 251-1744
aggagcggaagccggtgtttcgcagcccagagcatttgcagctggtcactccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaattataatcgctggttatgtcaagcaagatctgaggatctgtctgatattgcttctctaaaagccttataccaaacaggtgttgataactgtggtcgaacagtgatggtggtagttggaagaaacattcctgtaacattaatagatatggacaaggctctcttatatttcattcatgtaatggatcacattgctgtgaaggagtatgtattagtgtattttcacaccctgaccagcgaatacaatcacctggactccgacttcctgaagaaactctacgatgttgttgatgtcaagtacaagaggaatttgaaggctgtttattttgtacatcccacatttcgttcaaaggtgtcaacatggttttttaccaccttttctgtctcaggactgaaggacaaaatccaccatgtggacagcctccaccagctgttttctgccatatcaccagaacagattgactttcctccttttgtccttgaatatgatgccagggaaaacgggccttactatacatcatatcccccatcaccagatttgtgacctgccatctttcagtgcttcttggttcccaggatgccacttcctccacgaatagctacctgttgaagtgatattcattgttgctgtacagatccagagagccttttgtccccacctctctggtatttttttattgactgtatattttctggcacataagcaatctaaaaatggtaggccattctgaactgcacacattttaaatttgtatatttatatgaaatggaaatgttcatttttagattgttaatagaaattggggagcaacttttgagtatctttagtttcctgaaggacaccgaattctccattagataaaccaccaagactgttcacatcatctctctaacattgcacgcttcctttgtgtacttaagtgattctcgaaatatacagaaccaatgtatgctaaccagatgcattgtttgcttcagatccatggtgttaataccatgtatattttataaagataatttggctgtgttaaaagagaattacctgagtccaagaatgtggaaatgtatctgacaaaaaacatcaaaatcattagcaaaacataggacttagaatgttaatgtacaagttaagactaaagtttaaggactaaggttccttggattatatgacttgttaagattgccacagttccgatctcaacagtgtggggtgaaacaagaagactgtatcttcagcctttttcctataatcatggatgatttggtcttattcaaaaggaccgcacatattagtactcttaagagcatcttccaagactccagcagtgagcatttagagagtgtgttgtcttccagagtcatgaatgattttgtttagctatcaggtctactacctctaaggacatttcatagcagcatctcttgagttgcctgcatcagtgtggaggaagtgtgtcacagtgaacaaatccagggagctgataattggcaaaagaccacttttaccactcaggctctatttgtgccttagcttggttatgagtaaaaattagaattatgctgcctacctcacagaggtatcatgaagatagcatttagaaagggctttgttgtggtggggtatcttcagttagtttttaaatgggaataaatatatatgagggaatgctacacagcactcctcttgtccttgataccatttgagtgatttttctttttgtgtggcaatacctgttagtgtaaaattccaaccctgatgacctccttcctcttttgtccagaatctcttctggcctgctcatcccctgatgctatacttcaataagaggcatctgttggccattttaaacatttcttcttgaattaaggtcaaaccattattattcccatctgggtagctttgtactttttttgattcctacagccacctccccacagccccatcttcctcaccccatcacgtacattggcagttcagagaaaaaaaaaagcagaacctttctgttctatcatgtgctccagatcagtgcttccaagggtcccattcttttctgcccaaactaattcttcattggagatcaaagaaacatattctcttcatttatgatagggaaatgcccctatagtgcattaaattcatcctgtattttcccatataaacaagaagagactttacattttttagataaaggttcttatcttttgcatgtattgaacacattttctttgtgtcagacctcaaaattacttgatccttatatatacatctatgttaagattttctcttatgtcccctaggtcatcacatccaggcagccagtcagatgtcggatgttaagctttctctcaaacagtactttttttttaaccccttgggcactgtaccttaaaagtctgcaactttaacttcatcttctacagtcaatcgtgagatcatatttgaggtatcttcttcacaaggagcagctatgaaagtctgccaacttttctttgttaaaggggaacttggctacctcaagaacctggcccaaaccattttctgtagagataatagaggccgtaagctactttgccaatttgaaaggaagcaaatttatatatacaatttcttacaggcaatgattttgaaaggatgttcctttgctatattcataccagtatattaatgtttagtaacacaagcaggattctacatatgctgagattttagtacaattgatgtcctagggtataaaggtgatacagaactatatacatatcaactgtgttttataattcaatgatgactaaagaaagataaggaccactcttctcactgaaactaaatttgatgtgggaccaagttcatgcttttatagatgtctaaagtgttatagaatgaagttgcttcaaagtaccaaatcctagaggagaaatataatgaccttgatattgaaatgattaagcaacatttggtataccaatctgcctttgtgaaaaggtttagcctgaataatacatgccattttcaaggacatattagaggataaaggggatactggatggagatgaccaccagcatctgatgttaattcaaagcaccaccaagtctttaatttaattaaactttggtcatgccaaatgctaattgaattgttgaagacacaagttataaaatattaatttattaatcatgcaaggcataatatgatttttaaaacaagtacacttcttgcttccacgtgtatttgggttcttaattcatctatatccaagtttcttgatagtgaaaattacctcttaaaaaaggttcagcctttattagactcgtgagggcaaatggtacatattttaaagacgttttctcctttaatgtatattatgtttcattggcggatgctttatatttcctttttctttttcttttttttttggagacagtcttactctgtcacccaagctggagtgcaatggtgtgatctcggctcactgcagcctcggcctcccaggtttaagtggttctcctgcctcagcctccctagtagctgggactacaggtgcctgccaccatgcctggctaatttttttttttttttttttttttttcagtagagacagggtttcaccatgttggccagactggtctcaaactcctgacctcaagtgatcttcctgcctcggcctcccaaagtgttgggcttaccagtatgagccaccgtgcccatcctgtatttcctttttcaaaggaatacatctgcagtattttgagagtaattagcagagggttttttgagtatttttggtaggaaaaatagatgtagttttttaatcaaatttctgaaattgaaaatatcacttctttttaaagagggataagtatagtcactctagtagaaaaacatggcttgcctatttcctcttcttttctgtttgcttggatattgtttaatgaattcaaactgtaggtttagtcttgtctttataacagttaatggagaagtgataaaattaagtattcagcataaactaaagatcactctttgtatttccccgatacattgacagtatgtatgtatatagagtttaaattgcttaatatatgcacagaaatgattagaatttgaagtactatatagaggagagttacatggttctagtggcagtggattgattgtattaaggaccaaaagaactgcaggataatataaaaacaccttgaaaactggagttagttaggtttctttttctttttcttttttttttttaaagggccttactgtactttttttttttttttggtcacccaggctggagtgcaatggcacgatctcggctcactgtaatctctgtctcctgggttcaagagattctcctgtctcagcctccccagtaagtgagattatagacatgcaccaccatgcccggctaatttttgtatttttagtagagacggggtttcaccatgttggccaggctgctctcgaattcctgacctcaggtgatctgcccaccttggcttctcaaagtgccagattacaggcataagccactgtgcctggccaggtttctgattatagttttcttaagttgtaatcatcataattaacgtgcgctagagtgttttaactgtgctggcactaatgcttcttggcatataattaactcttgttttgcaaaaagaccatgaagaatgaaaggagggctttaccttaccttagtcattttgggtgaataccgtaaactgggtggcgtaacaaaacacatttatttctcacagttggaggctgagaaaccccaagatcaaagtgccatccagcgcaattcctgatgagggccctcttctggcttcttgctgtattctcacttggcagagagagagagacatcgttactttcctgtctcttcttataagggcactaatctcattcatgagggctccaccctcatgacatgattaccacccagaggccccacctccaaatgccatcactttgtatgttagggcttcaacatatgaatttgcagacgaggaggagaacataagcattcagttcataacatacctataatctaggtcatatcataaacccagagatgataaggattgcctggtaggcctaaccatatatacatatacatgcatgcacacacacatatatgcataatctgccttgttttacattctttgagtcggacttctgtggtccatatgtagagaacatagagcaataaataacctagttcaatctttgagtcttactgaactagtccttaaacagatggtatcaagatcattttagatattagtgactctcttgtatattagttattttttacacttttaagaacagcatctttgaatcttttcaagtacagtatgccttaaatgtataggaccactgagttcaggaagaaaagcataggtattctgtaggtgaattacactaacaaaatcacaactgcagaatgtgatctgatacttttgttggacagtaaagctaatacattttatatacacagtcataccttttttttttgtaatgtgtttcgttaacgtaagcacacagtcatcacagactgagacaggactttgttagaccagatcttgtgagctaaatatttaagagcttaacatatataaatgattttaattggtattgggcgaaggaaacctaaaaatgcttaaattgacagatcttacaatttgcttactgaaaattcagaaagcttttatgaaaactttgtattttaaaatattttttgctcattctgaattagaagttagatcccttttaaagagggtctcactctatacaaatatagcctatgaagaatcaatagtgaaataatagtgtttatattgaaccccaggatgggacattattttttgaccatttacatgaggtctttctctaattaccaaagttaaccttaagagtagttaaaaactcagtgaattttagtcaacattctctgtggagacctggactagtgtttcccaaactttcatgtgcatgtatcaaatcagctgaggatattattaaatggagattcagattcaatagttctggggtggcctctgggattatcagtttctaacaagctcttaggtgttatcaattctcctggtccccagaccatagttagagtaaaagagtatagactgcatttagcttccagattttctctttcaaggaaaggagacagaactgtcattgtaattcttcctgtggtccaggcactctaacgttcatcgtctcttctaatgctcttacaaatcctgtgaggttggtgataatagaagttacctcctgaagacgacattcacaagcaggaccgaccgtgtagaccagttttctcaaactgaataatgtacttcactttttaataaggaaaaaaatctcttagctcctcagtttttgcttaatttatatttattataatgttatctaaatatatataaacataaaactaggtataaatgctttatgtttatatgtcttgcacaagtataaaaccaaaacaagtttatgggttaacacaagcaaaactataaaactaataaaatttaaaatagtattaaatagtgatgttttgacaaaatgaaattgtcacttgtaatgtgattatggtactgagtgctacagtacaggctcttttcagttcaacaggcatgtactgccatgtactatgtgatgacccaattcaccctgttttctcctattcagactattactttaatttgttcagcacatagtgatgttatttggtcctcatctagcctgaatccatcattcccctattaaaacagcctctgttctccataagccttccaccactaatgtagaactgggccttaacagggaagtcaatacaaatacaaacctaagcactgagatggttctgccaatatttggttttaatacaattatccaaataattcagagcatgaatattattttaaaatgtttcatcaacatgaataatgcataattctcatagtaagttcatgggcactttcctacacccaacacatatatactccacaaggattttgcatggaccccagtttaagaagcaacaatttagtggtcagtagcattggcgctttggcttctgacacactcagaccttgggcctgtttctcaactttttctgaacctcagtgtttttgtgtattcaacagggataatattaattgaataattaggaggaacaaatgcaataatgtacataaagcatgcatagtagtgtttataaatagcagccaccactgctttgattagaaataataacagctaacatttgaggatttactgtgtgccttgaacgctgctaagctctttatatatattacatattgagtggtagaatcaggattcaaatccagatctgactccaaagcgcatgcttttataaaacataatttaaatatagaatatcaatgtaaattgcttatttagaaagtttattttcttatattttctcaaaaatatttattgtcaaatcagtgattctgtagaggggtaaatagctaaatttccttttaaaaattgtatgatgtgctgatttcaaattgatgtgaaatacagatttcatttaaaggcagtcatgccagattgtgctacagtaaaggaatattcagacca

SEQ ID NO: 136557 - DNA, 3037 bp, Homo sapiens
  Payload ID: 6719
  Gene Symbol: GJA1
  Gene Name: gap junction protein, alpha 1, 43kDa
  Uniprot ID: P17302
  ENST ID: ENST00000282561
  CDS Start-End: 158-1306
gcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 136558 - DNA, 1652 bp, Homo sapiens
  Payload ID: 6720
  Gene Symbol: GJA10
  Gene Name: gap junction protein, alpha 10, 62kDa
  Uniprot ID: Q969M2
  ENST ID: ENST00000369352
  CDS Start-End: 1-1632
atgggggactggaacttattgggtggcatcctagaggaagttcactcccactcaaccatagtggggaaaatctggctgaccatcctcttcatcttccgaatgctggtacttcgtgtggctgctgaggatgtctgggatgatgaacagtcagcatttgcctgcaacacccggcagccaggttgcaacaatatctgttatgatgatgcattccctatctctttgatcaggttctgggttttacagatcatctttgtgtcttctccttctttggtctatatgggccatgcactttataggctcagggcctttgagaaagacaggcagaggaaaaagtcacaccttagagcccagatggagaatccagatcttgacttggaggagcagcaaagaatagatagggaactgaggaggttagaggagcagaagaggatccataaagtccctctgaaaggatgtctgctgcgtacttatgtcttacacatcttgaccagatctgtgctggaagtaggattcatgataggccaatatattctctatgggtttcaaatgcaccccctttacaaatgcactcaacctccttgccccaatgcggtggattgctttgtatccaggcccactgagaagacaattttcatgctttttatgcacagcattgcagccatttccttgttactcaatatactggaaatatttcatctaggcatcagaaaaattatgaggacactttataagaaatccagcagtgagggcattgaggatgaaacaggccctccattccatttgaagaaatattctgtggcccagcagtgtatgatttgctcttcattgcctgaaagaatctctccacttcaagctaacaatcaacagcaagtcattcgagttaatgtgccaaagtctaaaaccatgtggcaaatcccacagccaaggcaacttgaagtagacccttccaatgggaaaaaggactggtctgagaaggatcagcatagcggacagctccatgttcacagcccgtgtccctgggctggcagtgctggaaatcagcacctgggacagcaatcagaccattcctcatttggcctgcagaatacaatgtctcagtcctggctaggtacaactacggctcctagaaactgtccatcctttgcagtaggaacctgggagcagtcccaggacccagaaccctcaggtgagcctctcacagatcttcatagtcactgcagagacagtgaaggcagcatgagagagagtggggtctggatagacagatctcgcccaggcagtcgcaaggccagctttctgtccagattgttgtctgaaaagcgacatctgcacagtgactcaggaagctctggttctcggaatagctcctgcttggattttcctcactgggaaaacagcccctcacctctgccttcagtcactgggcacagaacatcaatggtaagacaggcagccctaccgatcatggaactatcacaagagctgttccattctggatgctttctttttcctttctttcttcctggggtgtgtatgtatgtttgtgttgacagagaggcagatggagggggagattatttatggagagataaaattattcattcgatacattcagttaaattcaattcataaaatagacttagaaaaatctt

SEQ ID NO: 136559 - DNA, 5211 bp, Homo sapiens
  Payload ID: 6721
  Gene Symbol: GJA3
  Gene Name: gap junction protein, alpha 3, 46kDa
  Uniprot ID: Q9Y6H8
  ENST ID: ENST00000241125
  CDS Start-End: 178-1485
cactggggctgcagggatggcgatcagggcggggaggtcgggccctggcgcggggcgcacgcgtgaagcagcaccgcacgtgtgaaaggaattcttttcagagcggccgggagccctgctccggaggaacgcacccgggtcgccgccgcggcagagcggggttaggaatctgaagcaatgggcgactggagctttctgggaagactcttagaaaatgcacaggagcactccacggtcatcggcaaggtttggctgaccgtgctgttcatcttccgcatcttggtgctgggggccgcggcggaggacgtgtggggcgatgagcagtcagacttcacctgcaacacccagcagccgggctgcgagaacgtctgctacgacagggccttccccatctcccacatccgcttctgggcgctgcagatcatcttcgtgtccacgcccaccctcatctacctgggccacgtgctgcacatcgtgcgcatggaagagaagaagaaagagagggaggaggaggagcagctgaagagagagagccccagccccaaggagccaccgcaggacaatccctcgtcgcgggacgaccgcggcagggtgcgcatggccggggcgctgctgcggacctacgtcttcaacatcatcttcaagacgctgttcgaggtgggcttcatcgccggccagtactttctgtacggcttcgagctgaagccgctctaccgctgcgaccgctggccctgccccaacacggtggactgcttcatctccaggcccacggagaagaccatcttcatcatcttcatgctggcggtggcctgcgcgtccctgctgctcaacatgctggagatctaccacctgggctggaagaagctcaagcagggcgtgaccagccgcctcggcccggacgcctccgaggccccgctggggacagccgatcccccgcccctgccccccagctcccggccgcccgccgttgccatcgggttcccaccctactatgcgcacaccgctgcgcccctgggacaggcccgcgccgtgggctaccccggggccccgccaccagccgcggacttcaaactgctagccctgaccgaggcgcgcggaaagggccagtccgccaagctctacaacggccaccaccacctgctgatgactgagcagaactgggccaaccaggcggccgagcggcagcccccggcgctcaaggcttacccggcagcgtccacgcctgcagcccccagccccgtcggcagcagctccccgccactcgcgcacgaggctgaggcgggcgcggcgcccctgctgctggatgggagcggcagcagtctggaggggagcgccctggcagggacccccgaggaggaggagcaggccgtgaccaccgcggcccagatgcaccagccgcccttgcccctcggagacccaggtcgggccagcaaggccagcagggccagcagcgggcgggccagaccggaggacttggccatctagtgcccgggtgcctgcctccagacagctgtgtagtgatctttttcttagaaaccaaaaccaaagtgcacttcccaccagcagatagaacctgaaagtcccaggaggtgggagcgactggagtcccaggaggtggacgatggaggagagatcaggtttccgtgttcaatgcttgctgttcttagcactgtgagttacagtggggataactcccactttctgagtttgggggtggcggggacaagggttgtgggcctttaagatcttcacagcagcccagaaatctggtcgctgagggctgtctctgggggtaactgttctgtagtggtaaagcaacaggtatcctgcagtccctttagctcctgggcaattgggtttgctattcctaagctctccagagcctctgggcggcccagagggtcttagctctgggccagagcacttagctctatctctttgatacttttaacttagagttgaatttcatttgggatatttgccaaactgcactaaaaaaagatttacagcaagtctatgtagtgtcatttgagtttccgaaattgcatgtgaagcccaggatatcaagcttcaggcctcatgacaagtgacaaagagcagttgccctccagaggcaggctcagtgggcaagggccccagaggttgctggcagaaggcaggtggaaacgcagccacgcctgaggccatttttaaacagttgaggaaattgacataaaagtgtgtcgggtatgccgtaggtatttattttctaaatgattattttgtgctttgaatggtgcagctatgcctattttctcccactttctttcaggaaaaatgaaagaaaaatagtgtttttctttctttaaatactgttagaatgattgctgaccaagacagtgctaatttgccctaatgcatgctactagcatctttactaaagattttgaactttcttgtaaaagaaattctttaatttcatgagtcacctaattataatgagaatgtattatataaaacaaaagcaggggaaagttttaagtgcattcaaatagaagttctgaagattttgaatgggaagtgaaaagtgaactactgttgccaggaaaattatttatacagatgaatctatgacaatctacacttttaaaaagtacagaataaaacacttcaagcttcctaatcattctttgtgggcagcctgtttgctttctccagtgtaaataatataagtgtctggggatccctgcctgggggagggcgcgtgctcatgcaggctgtatgccccattctgcctccacaccagagctgtcctgacagggaaggctatttatgtgtgtgggcatggctggaagacggcagaattttctgtcctgcacacacagctgtagtatcttggtcaccatttgtttataaaatgaacgatggtcatgttgagcctgtttctactcacacttttcacctccaacttctactgagtatcattagcccttgttcagcgagaccaatgtaatacatttctttttataaattaacttctcgatgatgcatttgggaccacactccaaacatactttctgttttctatcataaagggtgctccactaacaatctgatgaaaggaatgcaatttccaagtctcagattcttgcatgcaactagtttttcatgtcagtcaaacacaaagaatttgttagtacattctgcttgctgtaggatgcactggacaggctcctaggcttgaaaaatgctaacttttccatacgtctcctcagagactttctcaaccagattgacaagagagaaattagccctttggaaaactgtgagtgactttctcactcctctccaggctggtgcataactacagccattctagatgcataacttctctccgaagttcactcattacatgcagtgtatgccataggcctagggcagcaggacttagttcttgtgagtgataagggctgctagaagatcctagtgtgagaagcattccgataaaaagctttggccattttagaaaatgcaatagcaatcatccaagagcacaagtacagctcaagtacaagtggatgtcaatacttggttctttaagttctaccataataaatgttcataacagtaacaagcttcttatttacccacaatttgattttgagtggggttggagatgagcatgagaactcaaattgtatctagtttttacattttaaaattgaatttagtcacaatatgtttatggaaatgccagtattgtaccattgaccatagtctagtgggtccatttagagtggataggagtgtagaattagattcacctacttgaaaatcactaatctataaagaagtgaggttttgcaatagaacagtgcctgtggtgttttttcaggttagcatactgatttcagttcatgtaagaaatgaacgcatgtttcacatccttttgctctttgaggtatccatgattctaaaggctgggtccttctctctcaggcagtgtggaattgttctctactcaactagtcctttaagacattgaaacatgcaataaaaatagaaattgcctctctctgtgggcaagattccagacctatttttttctagcctggaaatttcactgaaactattttgttcttgattcattagaaagttttaaaaaatctctaagcctattttaaaactcaaatgctatacctatagcatttgagtattatatttacatacatggtttttaagctgctgtatacaattacttcttatatccctgtttttataaaatgttaaacatcactatagttacagtaccaaaaatcattttttaaattctaaaactattacttatattatcactcactttctcctttttaaacttttaatggttattcttgtattttttaataaaattgacacgaataaatccttaaatttacaaaagaaaaatagcaagccagcatctttctcatttatcctggatttcttcggctctggacaagtaagtggataggtcatagaattcctacacaagaatacctggactaataactatgaatataatttaaacatcactttacaaaaaattaatccaatagggtttaggtctcctttcacgttaggctttttaaaaagtattattaacactttctttattttgtattactgaataaactccttttttctgaattttttgaacttctgatatttgtaacactaattcatgaatctccaccaaaataaatacttatagagagtattgcatgatttaagagagtaaatgtgttttccaaagatgaatagagtcctgccaccatcaccacccgccacccctacaaattgaggatatcctaaataacctttaatatagcatatggacattgtacatttaaggtcagggaaggcacttttcttcctaattttatattacagtgcaaatcttgggttgactcactttaaggtttctgactgcccaaaatattttttcccctttacgttacagaacattataataaggcaaacaagttagggatttgaataacactcaaagcaacaaactgtttccagaaagtaccatatttgaagctgtttggtgtgtaaatgttcatttagctcatgtatttacaaaactcttactaaaacttaatttttgtgccataacagtgtctttcctggattacattgtaactggaagtaagcattttctaaaataataaaagtgcccttaagtttaaa

SEQ ID NO: 136560 - DNA, 1622 bp, Homo sapiens
  Payload ID: 6722
  Gene Symbol: GJA4
  Gene Name: gap junction protein, alpha 4, 37kDa
  Uniprot ID: P35212
  ENST ID: ENST00000342280
  CDS Start-End: 89-1090
cagcagggctcccgcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcaggtgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaa

SEQ ID NO: 136561 - DNA, 1059 bp, Homo sapiens
  Payload ID: 6722
  Gene Symbol: GJA4
  Gene Name: gap junction protein, alpha 4, 37kDa
  ENST ID: ENST00000450137
  CDS Start-End: 183-1059
agcagggctcccgcgggcgtcactccggccatcgtccccacctccacctgggccgcccggcaggcaggcggtagaacgggcgtggcagacctccctgcaggcttgttgctgggcgaacgagaaggatgccatgctgacacactgacgtgctctgtctccttgcagacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggcca

SEQ ID NO: 136562 - DNA, 891 bp, Homo sapiens
  Payload ID: 6723
  Gene Symbol: GJA5
  Gene Name: gap junction protein, alpha 5, 40kDa
  ENST ID: ENST00000430508
  CDS Start-End: 137-891
actgacaggctcaagagcaaaaagcgtgggcagttggagaagaagcagccagagtgtgaagaagcccacggaaggaaagtccagggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctgg

SEQ ID NO: 136563 - DNA, 3181 bp, Homo sapiens
  Payload ID: 6723
  Gene Symbol: GJA5
  Gene Name: gap junction protein, alpha 5, 40kDa
  Uniprot ID: P36382
  ENST ID: ENST00000579774
  CDS Start-End: 142-1218
ctctggtgatacagaagaaaagacagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaggaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccctggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatcta

SEQ ID NO: 136564 - DNA, 3183 bp, Homo sapiens
  Payload ID: 6723
  Gene Symbol: GJA5
  Gene Name: gap junction protein, alpha 5, 40kDa
  Uniprot ID: P36382
  ENST ID: ENST00000621517
  CDS Start-End: 145-1221
gaggaacaactgacaggctcaagagcaaaaagcgtgggcagttggagaagaagcagccagagtgtgaagaagcccacggaaggaaagtccagggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaggaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccctggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatct

SEQ ID NO: 136565 - DNA, 1302 bp, Homo sapiens
  Payload ID: 6724
  Gene Symbol: GJA8
  Gene Name: gap junction protein, alpha 8, 50kDa
  Uniprot ID: P48165
  ENST ID: ENST00000369235
  CDS Start-End: 1-1302
atgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgaggcggaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgggccacctgggcctgaaggggatccggtctgccttgaagaggcctgtagagcagcccctgggggagattcctgagaaatccctccactccattgctgtctcctccatccagaaagccaagggctatcagctcctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatga

SEQ ID NO: 136566 - DNA, 1799 bp, Homo sapiens
  Payload ID: 6725
  Gene Symbol: GJA9
  Gene Name: gap junction protein, alpha 9, 59kDa
  Uniprot ID: P57773
  ENST ID: ENST00000357771
  CDS Start-End: 252-1799
atggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaa

SEQ ID NO: 136567 - DNA, 1901 bp, Homo sapiens
  Payload ID: 6725
  Gene Symbol: GJA9
  Gene Name: gap junction protein, alpha 9, 59kDa
  Uniprot ID: P57773
  ENST ID: ENST00000360786
  CDS Start-End: 254-1801
cagggagttgtggttgcaacactgtactccagcctgggcaacagagggagactctgtctcaacaaacaaacaaacaaagaaaaaaccccacagctatctagggaaaaagtaaagcaaccagcatatagaagtgacatattgttatattttcaccataggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagct

SEQ ID NO: 136568 - DNA, 1637 bp, Homo sapiens
  Payload ID: 6726
  Gene Symbol: GJB1
  Gene Name: gap junction protein, beta 1, 32kDa
  Uniprot ID: P08034
  ENST ID: ENST00000361726
  CDS Start-End: 147-998
atatgactccccagcaccgggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 136569 - DNA, 1904 bp, Homo sapiens
  Payload ID: 6726
  Gene Symbol: GJB1
  Gene Name: gap junction protein, beta 1, 32kDa
  Uniprot ID: P08034
  ENST ID: ENST00000374022
  CDS Start-End: 96-947
ctggtggcatagggcagacacgcctgcagacattctctgggaaagggcagcagcagccaggtgtggcagtgacagggaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaa

SEQ ID NO: 136570 - DNA, 1587 bp, Homo sapiens
  Payload ID: 6726
  Gene Symbol: GJB1
  Gene Name: gap junction protein, beta 1, 32kDa
  Uniprot ID: P08034
  ENST ID: ENST00000374029
  CDS Start-End: 95-946
gggctgggctgacagtacctggtggcatagggcagacacgcctgcagacattctctgggaaagggcagcagcagccaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatg

SEQ ID NO: 136571 - DNA, 484 bp, Homo sapiens
  Payload ID: 6726
  Gene Symbol: GJB1
  Gene Name: gap junction protein, beta 1, 32kDa
  ENST ID: ENST00000447581
  CDS Start-End: 232-484
cagcagcagccaggtgtggcagtgacagggagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagttt

SEQ ID NO: 136572 - DNA, 2309 bp, Homo sapiens
  Payload ID: 6727
  Gene Symbol: GJB2
  Gene Name: gap junction protein, beta 2, 26kDa
  Uniprot ID: P29033
  ENST ID: ENST00000382844
  CDS Start-End: 200-880
atttaatcctatgacaaactaagttggttctgtcttcacctgttttggtgaggttgtgtaagagttggtgtttgctcaggaagagatttaagcatgcttgcttacccagactcagagaagtctccctgttctgtcctagctagtgattcctgtgttgtgtgcattcgtcttttccagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaagtctgttgattaaagatgagctttgtctacttcaaaagtttgtttgcttaccccttcagcctccaattttttaagtgaaaatatagctaataacatgtgaaaagaatagaagctaaggtttagataaatattgagcagatctataggaagattgaacctgaatattgccattatgcttgacatggtttccaaaaaatggtactccacatatttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataat

SEQ ID NO: 136573 - DNA, 2250 bp, Homo sapiens
  Payload ID: 6727
  Gene Symbol: GJB2
  Gene Name: gap junction protein, beta 2, 26kDa
  Uniprot ID: P29033
  ENST ID: ENST00000382848
  CDS Start-End: 139-819
cggagcccctcggcggcgcccggcccaggacccgcctaggagcgcaggagccccagcgcagagaccccaacgccgagacccccgccccggccccgccgcgcttcctcccgacgcagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaagtctgttgattaaagatgagctttgtctacttcaaaagtttgtttgcttaccccttcagcctccaattttttaagtgaaaatatagctaataacatgtgaaaagaatagaagctaaggtttagataaatattgagcagatctataggaagattgaacctgaatattgccattatgcttgacatggtttccaaaaaatggtactccacatatttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataa

SEQ ID NO: 136574 - DNA, 1797 bp, Homo sapiens
  Payload ID: 6728
  Gene Symbol: GJB3
  Gene Name: gap junction protein, beta 3, 31kDa
  Uniprot ID: O75712
  ENST ID: ENST00000373362
  CDS Start-End: 191-1003
agacagcacccaagggtagaagatgggggcccaggagggagctgcaccctggtgggcagccatgggagtgtgtcaggtggaagcagccgtcagggtccctctctgctctctgtccggacagacagggctccaaccttcacttcagttcttgtgaactcccaccaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggt

SEQ ID NO: 136575 - DNA, 2217 bp, Homo sapiens
  Payload ID: 6728
  Gene Symbol: GJB3
  Gene Name: gap junction protein, beta 3, 31kDa
  Uniprot ID: O75712
  ENST ID: ENST00000373366
  CDS Start-End: 616-1428
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttata

SEQ ID NO: 136576 - DNA, 2840 bp, Homo sapiens
  Payload ID: 6729
  Gene Symbol: GJB4
  Gene Name: gap junction protein, beta 4, 30.3kDa
  Uniprot ID: Q9NTQ9
  ENST ID: ENST00000339480
  CDS Start-End: 371-1171
aaacagacaagcccaaggacaaggaagcagctactggacccaagaaggaataaggtagaccctgattttggaacctgaagaccaaagtgcaagattagctctgctacttccatctgtggaccattgggcaggtatctctgggccttcacttactctttgtgaaatgaggacaggggcaatccctaccctaccaagtcattgggagtgaagacatgatgacacggtgattgtgaaaagattttgtcaatcgcaccagcattaagggtgcccatctccaggttcccccaggcctcaaggctcccaaggcctgagtgggcaggtagcacccaggtatagaccttccacgtgcagcacccaggacacagccagcatgaactgggcatttctgcagggcctgctgagtggcgtgaacaagtactccacagtgctgagccgcatctggctgtctgtggtgttcatctttcgtgtgctggtgtacgtggtggcagcggaggaggtgtgggacgatgagcagaaggactttgtctgcaacaccaagcagcccggctgccccaacgtctgctatgacgagttcttccccgtgtcccacgtgcgcctctgggccctacagctcatcctggtcacgtgcccctcactgctcgtggtcatgcacgtggcctaccgcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcccacggagaagaaggtcttcacctacttcatggtgaccacagctgccatctgcatcctgctcaacctcagtgaagtcttctacctggtgggcaagaggtgcatggagatcttcggccccaggcaccggcggcctcggtgccgggaatgcctacccgatacgtgcccaccatatgtcctctcccagggagggcaccctgaggatgggaactctgtcctaatgaaggctgggtcggccccagtggatgcaggtgggtatccataacctgcgagatcagcagataagatcaacaggtcccccccacatgaggccacccaggaaaaaaggcaggggcagtggcatccttgccgtagcagggtggtgaggagggtggctgtgggggctcaggaagctcgcccaggggccaatgtgggaggttgggggtagtttggtccctgggtcctgagcctcaggggagggaggttgatagctactggggattttgtatatggcaacagtatatgtcaaacctcttaataaatatgattttcccagtactttgcagaccaggtggggagtggccgataggaaaacggggggcaggggggattaggtggacctcagagaggatgccaagactactcagtgagcacctgagcactggaacctcagatccaggctcacccatcaccccccaacacacacagtgtgtgcccccagaacatgatgggctgtgcccaaaggcagaggctactccaggggcctctgggttgtgcaaccacctggccaaagcaggaggagaggaattccaggagaccctgtgcccagcaggagtcagttctcagtgatcgtccatcacaggaatgagcgtgggttgggcctccctagccctgcccagcacaggtcccggataggtgagtcccctctgacggtgggagggtcacggctgagagcaagccagggatgggaatctgtcaaggtgcccaagaggcacatcctacaggccagggcccactgagagtgtctgagctgaaaggtcccttgtggatcctggagtctatggaatttcatgttctttttcactgatacaacttccccatcccatactcccccaccccaccaccactcagactttggcaactcccagaaccacacctccaccctaacatgcctctgagtcccaccaaatgcccactagacaattccctgggaggcccccaggcatctcatacccgccactcccaagctgacctcatcagctcacccagacctgcccccttgaagatgccccaccccatctcatgcaggacacagctattcacccagctgcccaagccaggggacgagacaagcctgacatccttgtccctcacaccccacacccccactggcaccaaatcccactgattccagtccctaaatgccacctgaatctgctcttcctctccttacaacaacctaactacctcctggacctcccccatctgccctccgctacagggatggagtgatttatctgtctatgcaactgaccatgtcattccacctgctttaaaatttcttccaccatcaccagccccatgccctcagcatggcccccgctgacctccccacctcatcccagcttcctccccttttctacctgcaagtaataccaaagggctcctggttccccaggcagacacgtcatgtggtgtcattcctcgtgcctttgtcatgctatttcctctggctagaatgcccttcccaccccctctgtgatcctccctcgaacctctaggacagctttacccatctctctaagtgccagcctcgcttgtccctctgccactctccccaaatcggaattgtcacttcccctgagtgtctccctatcagtctgtgagcccttaatgggcaggtcactgagtcatccaggtccctgctgccttcaataaatgcttgttagatgagt

SEQ ID NO: 136577 - DNA, 1355 bp, Homo sapiens
  Payload ID: 6730
  Gene Symbol: GJB5
  Gene Name: gap junction protein, beta 5, 31.1kDa
  Uniprot ID: O95377
  ENST ID: ENST00000338513
  CDS Start-End: 174-995
agcacacccggcaggctctgtcctggaaacaggcttcaacgggcttccccgaaaaccttccccgcttctggatatgaaattcaagctgcttgctgagtcctattgccggctgctgggagccaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggt

SEQ ID NO: 136578 - DNA, 1808 bp, Homo sapiens
  Payload ID: 6731
  Gene Symbol: GJB6
  Gene Name: gap junction protein, beta 6, 30kDa
  Uniprot ID: O95452
  ENST ID: ENST00000241124
  CDS Start-End: 299-1084
acataactgggggtgtggagagcgcctcattgccactgcagtgactaaagctgggaagacgctggtcagttcacctgccccactggttgttttttaaacaaattctgatacaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 136579 - DNA, 2131 bp, Homo sapiens
  Payload ID: 6731
  Gene Symbol: GJB6
  Gene Name: gap junction protein, beta 6, 30kDa
  Uniprot ID: O95452
  ENST ID: ENST00000356192
  CDS Start-End: 622-1407
ccgcagcccgcccgagccgcgtcagggcagaggcggggtggggcgcggttaaaaggcgcagcaggtgggagccggggccttcacccgaaacccgacgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggaaggaaaagaagtacagaagatctggctaaacaatttctgtatggcgaaagaaaaattctaacttgtacgccctcttcatgcatctttaattcaatttgaatattccaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 136580 - DNA, 1805 bp, Homo sapiens
  Payload ID: 6731
  Gene Symbol: GJB6
  Gene Name: gap junction protein, beta 6, 30kDa
  Uniprot ID: O95452
  ENST ID: ENST00000400065
  CDS Start-End: 296-1081
cgacgagagcccgacagccggcggcgcccgagcccgacctgcctgcccagccggagcgaagggcgccgccccgcgcagagcccgcgccagggccgccggccgcagagcaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 136581 - DNA, 1927 bp, Homo sapiens
  Payload ID: 6731
  Gene Symbol: GJB6
  Gene Name: gap junction protein, beta 6, 30kDa
  Uniprot ID: O95452
  ENST ID: ENST00000400066
  CDS Start-End: 418-1203
acgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 136582 - DNA, 2173 bp, Homo sapiens
  Payload ID: 6732
  Gene Symbol: GJB7
  Gene Name: gap junction protein, beta 7, 25kDa
  Uniprot ID: Q6PEY0
  ENST ID: ENST00000296882
  CDS Start-End: 240-911
ttcattccgttaagttctacacattgtgttgcagggctgaaaaagcacgagtgtccgcactatgacaaaagaaaagcggcgtctcctcaaaacaccaccatgttcccctatgagtctggtgagccaagacactaagaaactgcaggaaacgagagagttctcggggtgggggtgtccatggatgaagcaccgaacaaactggagcccgcaagagtcttgccttcttttgagcctaagtcatgagttggatgttcctcagagatctcctgagtggagtaaataaatactccactgggactggatggatttggctggctgtcgtgtttgtcttccgtttgctggtctacatggtggcagcagagcacgtgtggaaagatgagcagaaagagtttgagtgcaacagtagacagcccggttgcaaaaatgtgtgttttgatgacttcttccccatttcccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcccaacactgtggactgcttcatctccaaacccactgagaagacgatcttcatcctcttcttggtcatcacctcatgcttgtgtattgtgttgaatttcattgaactgagttttttggttctcaagtgctttattaagtgctgtctccaaaaatatttaaaaaaacctcaagtcctcagtgtgtgagtgccacagcctcagatatgttgaatgtggtaggagagggacccctcccctactccagaatcttcacacttggccataaacacactccctctacctgaagcaaagctactctgtgacacacaagagggttaaacaaagaaaacctgcatccctcctcagcaaggcctaagctgagttggaagacaaagcacatcagccttagtatcatttgggaggaatttttttacattgtcaatatgctttcagttatgagctctagacagaggtctcattgttttgttgtagggttctccagtatgtggataacattagttgttttagaataggtaattgcaaattagtctgaagaaatctaacaggattcttttaagagcttagatttttcagggaaaaaaaaaaaaaaagaaaccctgtgtcagttttctgttttttctaactatctcattacaattggtgcacaatgaactggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaatcaagtagaaatattactgggaggtatcccacttaagcctgaaccagcagacatccgaaagggtcactctagagtcagaaaggaaagcaggtcccccagaaggcaacacattgataggaagtggaggccacagaaaaagaatgtgcccacttgataattacttaagacttctatttaaccaaaagaacattgaaatactttgtaaatattcatattgttgaacctttcataatcaggaattcactatgtactatactgtaagtcatagttcgcctataatttactagtatatctccctctaggacagatagtaaaatgtgtactatgttgttacagtggtgcaaaaatgttttaaaagtttatcacttgttttgaagactagaactttctttacttttctatattttcttagcaattcacagatatgttctctttggatttagtactttaacatatgtacatttcttcagaataaaaataagggtatttcacaatgc

SEQ ID NO: 136583 - DNA, 571 bp, Homo sapiens
  Payload ID: 6732
  Gene Symbol: GJB7
  Gene Name: gap junction protein, beta 7, 25kDa
  ENST ID: ENST00000369576
  CDS Start-End: 84-571
aaatcaaatgagtaactgactggatctcttattaatctccacatctgtgtaaagagagtcttgccttcttttgagcctaagtcatgagttggatgttcctcagagatctcctgagtggagtaaataaatactccactgggactggatggatttggctggctgtcgtgtttgtcttccgtttgctggtctacatggtggcagcagagcacgtgtggaaagatgagcagaaagagtttgagtgcaacagtagacagcccggttgcaaaaatgtgtgttttgatgacttcttccccatttcccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcc

SEQ ID NO: 136584 - DNA, 2281 bp, Homo sapiens
  Payload ID: 6732
  Gene Symbol: GJB7
  Gene Name: gap junction protein, beta 7, 25kDa
  Uniprot ID: Q6PEY0
  ENST ID: ENST00000525899
  CDS Start-End: 347-1018
ggggaggagccaagatggctgaataggaacagctccggtctacagctcccagagtgagcaacgcagaagatgggtgatttctgcatttccagtcgaggtaccgggttcatctcactagggagtgccagacactgggcgcagggctgaaaaagcacgagtgtccgcactatgacaaaagaaaagcggcgtctcctcaaaacaccaccatgttcccctatgagtctggtgagccaagacactaagaaactgcaggaaacgagagagttctcggggtgggggtgtccatggatgaagcaccgaacaaactggagcccgcaagagtcttgccttcttttgagcctaagtcatgagttggatgttcctcagagatctcctgagtggagtaaataaatactccactgggactggatggatttggctggctgtcgtgtttgtcttccgtttgctggtctacatggtggcagcagagcacgtgtggaaagatgagcagaaagagtttgagtgcaacagtagacagcccggttgcaaaaatgtgtgttttgatgacttcttccccatttcccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcccaacactgtggactgcttcatctccaaacccactgagaagacgatcttcatcctcttcttggtcatcacctcatgcttgtgtattgtgttgaatttcattgaactgagttttttggttctcaagtgctttattaagtgctgtctccaaaaatatttaaaaaaacctcaagtcctcagtgtgtgagtgccacagcctcagatatgttgaatgtggtaggagagggacccctcccctactccagaatcttcacacttggccataaacacactccctctacctgaagcaaagctactctgtgacacacaagagggttaaacaaagaaaacctgcatccctcctcagcaaggcctaagctgagttggaagacaaagcacatcagccttagtatcatttgggaggaatttttttacattgtcaatatgctttcagttatgagctctagacagaggtctcattgttttgttgtagggttctccagtatgtggataacattagttgttttagaataggtaattgcaaattagtctgaagaaatctaacaggattcttttaagagcttagatttttcagggaaaaaaaaaaaaaaagaaaccctgtgtcagttttctgttttttctaactatctcattacaattggtgcacaatgaactggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaatcaagtagaaatattactgggaggtatcccacttaagcctgaaccagcagacatccgaaagggtcactctagagtcagaaaggaaagcaggtcccccagaaggcaacacattgataggaagtggaggccacagaaaaagaatgtgcccacttgataattacttaagacttctatttaaccaaaagaacattgaaatactttgtaaatattcatattgttgaacctttcataatcaggaattcactatgtactatactgtaagtcatagttcgcctataatttactagtatatctccctctaggacagatagtaaaatgtgtactatgttgttacagtggtgcaaaaatgttttaaaagtttatcacttgttttgaagactagaactttctttacttttctatattttcttagcaattcacagatatgttctctttggatttagtactttaacatatgtacatttcttcagaataaaaataagggtatttcacaatgct

SEQ ID NO: 136585 - DNA, 2889 bp, Homo sapiens
  Payload ID: 6733
  Gene Symbol: GJD2
  Gene Name: gap junction protein, delta 2, 36kDa
  Uniprot ID: Q9UKL4
  ENST ID: ENST00000290374
  CDS Start-End: 478-1443
gctcggccctggcctcgcaggctgccgcgccggagcgccaggtgcccgctgaagtagcaggaacagagccggtgttcggaccctcccctggcccccaacctgcggcggagagcggcgctgagacttctcctgggcgggcgagcgctggaggacctgcaggctgccaccccgccccgcccctcgtcccggcgtccgcgggatccagacccgaaccccggacggcgcccgaggttcgtgccctctctctagaccgcgccaactgccccatcggtcgggacgcgcttggatttctttccccatttcttctcttttaagtacaataaaaggaaagggggattcgaggattttttaaaaaattgcttctttaattgggaggcaattcactcccattctggaagtgcggcccggggaggggccaggagcgggaacgtgcccggtgctgcccagtctttgtctgctgcctccggatgcacagcgatgggggaatggaccatcttggagaggctgctagaagccgcggtgcagcagcactccactatgatcgggaggatcctgttgactgtggtggtgatcttccggatcctcattgtggccattgtgggggagacggtgtacgatgatgagcagaccatgtttgtgtgcaacaccctgcagcccggctgtaaccaggcctgctatgaccgcgccttccccatctcccacatacgttactgggtcttccagatcataatggtgtgtacccccagtctttgcttcatcacctactctgtgcaccagtccgccaagcagcgagaacgccgctactctacagtcttcctagccctggacagagacccccctgagtccataggaggtcctggaggaactgggggtgggggcagtggtgggggcaaacgagaagataagaagttgcaaaatgctattgtgaatggggtgctgcagaacacagagaacaccagtaaggagacagagccagattgtttagaggttaaggagctgactccacacccatcaggtctacgcactgcatcaaaatccaagctcagaaggcaggaaggcatctcccgcttctacattatccaagtggtgttccgaaatgccctggaaattgggttcctggttggccaatattttctctatggctttagtgtcccagggttgtatgagtgtaaccgctacccctgcatcaaggaggtggaatgttatgtgtcccggccaactgagaagactgtctttctagtgttcatgtttgctgtaagtggcatctgtgttgtgctcaacctggctgaactcaaccacctgggatggcgcaagatcaagctggctgtgcgaggggctcaggccaagagaaagtcaatctatgagattcgtaacaaggacctgccaagggtcagtgttcccaattttggcaggactcagtccagtgactctgcctatgtgtgagagggcaggtttcatgaaggtctgggggatggcaaggagccccaaggcagatgactgctcagacgtggctgtatccaccctcatttatgtgaccctcaccattaagatgtaggataagactggataaaagaagattttgcaccaatgggaaaggaggaaaagtggacccattttcacatatcacctaattggttctacagagacgattgggtagagtgatgaaatggatcaattagacttctttggtccctttctgtttatggcctagcctgatcctgataacactgaacttgcacagctaccaagtaggacttagccctgctgagctctttattctggtgaatggtgtgagttgagtacttcattgatataaaatttgtgacctatctcaacccatccctttatcctgagccatgggacaaacatccttgaggcactcttcatgtatctcccccaccagcatgcccctttccctcaatccaaaatagcatgccagctttttttttttttttttttttttttccagaatctggccttacattagacctaatatgttttatttgcaaacttagagggaattacatggggtgcttattggagaacggccatggcagaggttttcattagagccccatctgactggcccttagtcgtgatgaaaaccttaggaatgtctcaatatttccagttttctaactcaaactgcactggtgctgtttactagggatgggggatgggtgggagggagggaattgcaatatgcaactacaacacttttgtgagattgttgttgcacagttaggcacacggttacgagcttcaggatatttctgccttccagcttgtggactttggttaacattaaaaagattttttttggctaatatcaagagtgtctagctgagccacagcatttgtaactggtgtatctcactcattttcttacatagttttgttgtgcaacacagctgcacggtcattttgccatgatttgaatttacctgtgtgcttacaccagagaccttaatcatcccatgtcaatcctgatttattattttttcagttactctttgaaacacacacacatatacagacacacatacaaaattactggcttaaaagacctgcaactaaacactattggctaacgtgtgtttacggtgacttatttgagacatataccaaaggttcaaaaacctattgcattggactgtcaatatgttttcttctttttgctcttatttatttaagtgccatactgtacctttcatatccactgtgtatttagttaaaatattggccaagagaaacatctgggtaatgtgcttttatgaagccctttgttccctttgaattatcattatcatttttgatttagatatggacatggtgtaacacacaactaaggatttgtttaaaataaagttcttgcctttttttgtaaaa

SEQ ID NO: 136586 - DNA, 885 bp, Homo sapiens
  Payload ID: 6734
  Gene Symbol: GJD3
  Gene Name: gap junction protein, delta 3, 31.9kDa
  Uniprot ID: Q8N144
  ENST ID: ENST00000578689
  CDS Start-End: 1-885
atgggggagtgggcgttcctgggctcgctgctggacgccgtgcagctgcagtcgccgctcgtgggccgcctctggctggtggtcatgctgatcttccgcatcctggtgctggccacggtgggcggcgccgtgttcgaggacgagcaagaggagttcgtgtgcaacacgctgcagccgggctgtcgccagacctgctacgaccgcgccttcccggtctcccactaccgcttctggctcttccacatcctgctgctctcggcgcccccggtgctgttcgtcgtctactccatgcaccgggcaggcaaggaggcgggcggcgctgaggcggcggcgcagtgcgcccccggactgcccgaggcccagtgcgcgccgtgcgccctgcgcgcccgccgcgcgcgccgctgctacctgctgagcgtggcgctgcgcctgctggccgagctgaccttcctgggcggccaggcgctgctctacggcttccgcgtggccccgcacttcgcgtgcgccggtccgccctgcccgcacacggtcgactgcttcgtgagccggcccaccgagaagaccgtcttcgtgctcttctatttcgcggtggggctgctgtcggcgctgctcagcgtagccgagctgggccacctgctctggaagggccgcccgcgcgccggggagcgtgacaaccgctgcaaccgtgcacacgaagaggcgcagaagctgctcccgccgccgccgccgccacctccgccaccggccctgccctcccggcgccccggccccgagccgtgcgccccgccggcctatgcgcacccggcgccggccagcctccgcgagtgcggcagcggccgcggcaaggcgtcaccggccaccggccgccgagatctggccatctag

SEQ ID NO: 136587 - DNA, 1580 bp, Homo sapiens
  Payload ID: 6735
  Gene Symbol: GJD4
  Gene Name: gap junction protein, delta 4, 40.1kDa
  Uniprot ID: Q96KN9
  ENST ID: ENST00000321660
  CDS Start-End: 159-1271
agaaaaacccacctcctactcctggctcagacctttgctttcttatctccagctcacacctttaagtcttatgtagttaaaggacatttatccgcctccttggagaacacagccctccagtgtctcctgcagcctggagcctgggacattctggaagcatggaaggcgtggacttgctagggtttctcatcatcacattaaactgcaacgtgaccatggtgggaaagctctggttcgtcctcacgatgctgctgcggatgctggtgattgtcttggcggggcgacccgtctaccaggacgagcaggagaggtttgtctgcaacacgctgcagccgggatgcgccaatgtttgctacgacgtcttctcccccgtgtctcacctgcggttctggctgatccagggcgtgtgcgtcctcctcccctccgccgtcttcagcgtctatgtcctgcaccgaggagccacgctcgccgcgctgggcccccgccgctgccccgacccccgggagccggcctccgggcagagacgctgcccgcggccattcggggagcgcggcggcctccaggtgcccgacttttcggccggctacatcatccacctcctcctccggaccctgctggaggcagccttcggggccttgcactactttctctttggattcctggccccgaagaagttcccttgcacgcgccctccgtgcacgggcgtggtggactgctacgtgtcgcggcccacagagaagtccctgctgatgctgttcctctgggcggtcagcgcgctgtcttttctgctgggcctcgccgacctggtctgcagcctgcggcggcggatgcgcaggaggccgggaccccccacaagcccctccatccggaagcagagcggagcctcaggccacgcggagggacgccggactgacgaggagggtgggcgggaggaagagggggcaccggcgcccccgggtgcacgcgccggaggggagggggctggcagccccaggcgtacatccagggtgtcagggcacacgaagattccggatgaggatgagagtgaggtgacatcctccgccagcgaaaagctgggcagacagccccggggcaggccccaccgagaggccgcccaggaccccaggggctcaggatccgaggagcagccctcagcagcccccagccgcctggccgcgcccccttcctgcagcagcctgcagccccctgacccgcctgccagctccagtggtgctccccacctgagagccaggaagtctgagtgggtgtgaaaaaaacagcacctggcggtgccccggggctcacgcctgtaatcccaacactttgggaggcccaggcaggaggatcgtttgagaatatatctccttgcccaagagtttgagaccagcctggacaacataatgagaccctcgtctctacaaaatatctaaaaattagctgggcacagtggctccctcctgtagtcccagctacttgggaggctgagatgggaggaccatttgagcctgggagatcgaggctgcagtgagccaagatcacggcactgcgctgcagcctgggcaacacagtgagaccctgtc

SEQ ID NO: 136588 - DNA, 916 bp, Homo sapiens
  Payload ID: 6736
  Gene Symbol: GJE1
  Gene Name: gap junction protein, epsilon 1, 23kDa
  Uniprot ID: A6NN92
  ENST ID: ENST00000450456
  CDS Start-End: 70-687
gcagaagcaaactggcaatgtgggtcaagaattaaccaacaggaatgccaggataacatctcctgagacatgtctctaaattacatcaaaaacttctatgaaggatgtgttaaacctccaactgtgattggtcaattccacacccttttctttggatcgatccgaatattcttcctcggggtgctaggctttgcagtttatgggaatgaggccttgcacttcatttgcgatccagacaaaagagaagtaaacctcttctgttacaatcagttcaggccaatcactccacaagtaagtttttctgcattacaactagttattgtcctggttcctggagctcttttccacctttatgctgcatgtaaaagcatcaatcaagaatgcattcttcaaaagcctatctacactataatttatatactctctgttttattaagaattagtctagcggcaatagcattctggcttcagatttacctctttggtttccaagtaaaatctctttacctgtgtgatgctagatctcttggggaaaacatgattataagatgcatggttccagaacactttgaaaaaaccatttttctcattgcaataaatacatttacaacaattacaattttattatttgttgctgagatttttgagatcatatttagaagattatactttccattcagacaatgaccaaataattacctattgtcatgctgcagttatttatcatttttatttagttttatcttactcagtgagtacaatttcaaaacaaacttacttcaatgtgtctgaaatttttgtctactataaaatatagtgcctggttgtaaggtaaggattcttgaagaaatatttcattttaattttgatcacttttattagaaaatatacacagaactactgttaatttattttt

SEQ ID NO: 136589 - DNA, 3295 bp, Homo sapiens
  Payload ID: 6737
  Gene Symbol: GJC1
  Gene Name: gap junction protein, gamma 1, 45kDa
  Uniprot ID: P36383
  ENST ID: ENST00000330514
  CDS Start-End: 512-1702
aaatccccctgagaggtgtatcggctgcttcagggaatagagcagatggggtgaaggtttttgcaaggcctttagtgacctgctttcaatttgctgcaattcttctgctttggctttttcctataggtgccagagttcatctgcttcatatttttactactgacgcatcttcctgtcgtatattcttagactgtggtgacttaagaatctttgggtcacctgttacatggtttctcctgccacctgtatggggaggagaagactggtattcaaactcaagcctgtttctatcttattctcattgatttttatgatacatagaaaactttgtttctttctgaaaatggcattttagtgattcattgttttctgtgggagaaagcttatgacctgctcttttctttttcccttccagagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccacc

SEQ ID NO: 136590 - DNA, 7640 bp, Homo sapiens
  Payload ID: 6737
  Gene Symbol: GJC1
  Gene Name: gap junction protein, gamma 1, 45kDa
  Uniprot ID: P36383
  ENST ID: ENST00000426548
  CDS Start-End: 271-1461
actgctaagagccccgactctagctagatccacgcagggcccgccagatcctcgaggaattgtagagcagaacctgggaggagacattagcatcccgtgctacaatggaccaaggcctcggcggagcgcgcagaagacaactctgggcccgctaaaccaacccaggatacccagagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 136591 - DNA, 7566 bp, Homo sapiens
  Payload ID: 6737
  Gene Symbol: GJC1
  Gene Name: gap junction protein, gamma 1, 45kDa
  Uniprot ID: P36383
  ENST ID: ENST00000590758
  CDS Start-End: 197-1387
gcactgctaagagccccgactctagctagatccacgcagggcccgccagatcctcgaggaattgtagagcagaacctgggaggagacattagcatcccgtgctacaatggaccaaggcctcggcggagcgcgcagaagacaactctgggcccgctaaaccaacccaggatacccagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 136592 - DNA, 586 bp, Homo sapiens
  Payload ID: 6737
  Gene Symbol: GJC1
  Gene Name: gap junction protein, gamma 1, 45kDa
  ENST ID: ENST00000591424
  CDS Start-End: 276-586
agagcactgctaagagccccgactctagctagatccacgcagggcccgccagatcctcgaggaattgtagagcagaacctgggaggagacattagcatcccgtgctacaatggaccaaggcctcggcggagcgcgcagaagacaactctgggcccgctaaaccaacccaggatacccagagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagca

SEQ ID NO: 136593 - DNA, 478 bp, Homo sapiens
  Payload ID: 6737
  Gene Symbol: GJC1
  Gene Name: gap junction protein, gamma 1, 45kDa
  ENST ID: ENST00000586267
  CDS Start-End: 269-478
gacaactacccgggcggttaggggcgcagggcggagccgggccgcccctcgccgcccgggctcttcgcgggctgctctttgtctccccgacctcgatccctgcgtctccggcggcgtgcgggctcgtctgaggcttcccgcatctccccgctggaactcctgcctcccggggagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacct

SEQ ID NO: 136594 - DNA, 1837 bp, Homo sapiens
  Payload ID: 6737
  Gene Symbol: GJC1
  Gene Name: gap junction protein, gamma 1, 45kDa
  Uniprot ID: P36383
  ENST ID: ENST00000592524
  CDS Start-End: 267-1457
cgggagcggcttctgcctcggctggagactgaggcgaaggcggcagcggcggaggaggtggaggagaggcgagggtgaaggcgatggcgacgcggggcacatgaggccgcgaccggcgggacgggccgaggcccggcggaggaggcggctccgggggaacccgccgccggagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatactttta

SEQ ID NO: 136595 - DNA, 572 bp, Homo sapiens
  Payload ID: 6737
  Gene Symbol: GJC1
  Gene Name: gap junction protein, gamma 1, 45kDa
  ENST ID: ENST00000587239
  CDS Start-End: 355-572
ggtgaatctcctgaggtcaggagttcgagaccagactggccaacggggcgaaaccccatctctactaaaaattagttggacgtggtggtgtgcgcctgtagtccagctactcgggaggctaaggcaggagaattgcttggacccaggagacggaggctacagtcagctgagattgcggtactgtgctccagcctgggtgacagagactcttgtctcaaagaaaaaaaagagaaagggaggaaaggagaaggaaggaagagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctccca

SEQ ID NO: 136596 - DNA, 545 bp, Homo sapiens
  Payload ID: 6737
  Gene Symbol: GJC1
  Gene Name: gap junction protein, gamma 1, 45kDa
  ENST ID: ENST00000586347
  CDS Start-End: 1-340
atctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttca

SEQ ID NO: 136597 - DNA, 3226 bp, Homo sapiens
  Payload ID: 6737
  Gene Symbol: GJC1
  Gene Name: gap junction protein, gamma 1, 45kDa
  ENST ID: ENST00000587113
  CDS Start-End: 1-783
gatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatgtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 136598 - DNA, 2243 bp, Homo sapiens
  Payload ID: 6738
  Gene Symbol: GJC2
  Gene Name: gap junction protein, gamma 2, 47kDa
  Uniprot ID: Q5T442
  ENST ID: ENST00000366714
  CDS Start-End: 176-1495
ggggaacaatggggcccttgagggcccctcctccagcccccattgtgcttggtggtgagaggtggccctggctcggccacacaccctcggggaggaccagcatccaagcaggtggaagggctctgagggagactggaattttctggcctggagaaggacccgcccgcccgcccctatgaccaacatgagctggagcttcctgacgcggctgctggaggagatccacaaccactccaccttcgtgggcaaggtgtggctcacggtgctggtggtcttccgcatcgtgctgacggctgtgggcggcgaggccatctactcggacgagcaggccaagttcacttgcaacacgcggcagccaggctgcgacaacgtctgctatgacgccttcgcgcccctgtcgcacgtgcgcttctgggtcttccagattgtggtcatctccacgccctcggtcatgtacctgggctacgccgtgcaccgcctggcccgtgcgtctgagcaggagcggcgccgcgccctccgccgccgcccggggccacgccgcgcgccccgagcgcacctgccgcccccgcacgccggctggcctgagcccgccgacctgggcgaggaggagcccatgctgggcctgggcgaggaggaggaggaggaggagacgggggcagccgagggcgccggcgaggaagcggaggaggcaggcgcggaggaggcgtgcactaaggcggtcggcgctgacggcaaggcggcagggaccccgggcccgaccgggcaacacgatgggcggaggcgcatccagcgggagggcctgatgcgcgtgtacgtggcccagctggtggccagggcagctttcgaggtggccttcctggtgggccagtacctgctgtacggcttcgaggtgcgaccgttctttccctgcagccgccagccctgcccgcacgtggtggactgcttcgtgtcgcgccctactgaaaagacggtcttcctgctggttatgtacgtggtcagctgcctgtgcctgctgctcaacctctgtgagatggcccacctgggcttgggcagcgcgcaggacgcggtgcgcggccgccgcggccccccggcctccgcccccgcccccgcgccgcggcccccgccctgcgccttccctgcggcggccgctggcttggcctgcccgcccgactacagcctggtggtgcgggcggccgagcgcgctcgggcgcatgaccagaacctggcaaacctggccctgcaggcgctgcgcgacggggcagcggctggggaccgcgaccgggacagttcgccgtgcgtcggcctccctgcggcctcccgggggccccccagagcaggcgcccccgcgtcccggacgggcagtgctacctctgcgggcactgtcggggagcagggccggcccggcacccacgagcggccaggagccaagcccagggctggctccgagaagggcagtgccagcagcagggacgggaagaccaccgtgtggatctgagggcgctggcttgcgagctgggccagggaggaggagggttggggggctccggtggaaacctgcgaccccttctcctcagccttctccttagccggtggcctcaggcagactctgcccagaggggcagccaggctgctcagggaaggggctgaaagcggcagaggagtgccctggcttggtcaccactggggccaaggtggggtggagagaggcctaggagccagaaagggccctctgctgtggtctgaaccccagggggagtggggcattgactccacccctgtcctgagctggaataggtcctctgggatgccagctctcccctttgtgcttccctgcagcaacccatggagggcccagggtgcctggtatgggcatcagttggtgggggtgcgggggtgcgtgtccccattccctgcaacagcaaatggggctccttcttcagccctccccttcccagccccaaactgagacagactgggagctgggagcctggggtggacaggaccataccctctttgagcttctgcgatgccggccttccgttcctctgggaggcttgaagttctgcaaagatgttgatatgccttgcagcttggacccaatgggtggtggtcagggcctgggggcttggccatgctgggggaatggggctctgggttcctgcctgtggcctgtctgtcctcctccctaattcagacccagcctcaagaggaaagggagtaaaataaaactaacttgtttataa

SEQ ID NO: 136599 - DNA, 1116 bp, Homo sapiens
  Payload ID: 6739
  Gene Symbol: GJC3
  Gene Name: gap junction protein, gamma 3, 30.2kDa
  Uniprot ID: Q8NFK1
  ENST ID: ENST00000312891
  CDS Start-End: 1-840
atgtgtggcaggttcctgcggcggctgctggcggaggagagccggcgctccacccccgtggggcgcctcttgcttcccgtgctcctgggattccgccttgtgctgctggctgccagtgggcctggagtctatggtgatgagcagagtgaattcgtgtgtcacacccagcagccgggctgcaaggctgcctgcttcgatgccttccaccccctctccccgctgcgtttctgggtcttccaggtcatcttggtggctgtacccagcgccctctatatgggtttcactctgtatcacgtgatctggcactgggaattatcaggaaaggggaaggaggaggagaccctgatccagggacgggagggcaacacagatgtcccaggggctggaagcctcaggctgctctgggcttatgtggctcagctgggggctcggcttgtcctggagggggcagccctggggttgcagtaccacctgtatgggttccagatgcccagctcctttgcatgtcgccgagaaccttgccttggtagtataacctgcaatctgtcccgcccctctgagaagaccattttcctaaagaccatgtttggagtcagcggtttctgtctcttgtttacttttttggagcttgtgcttctgggtttggggagatggtggaggacctggaagcacaaatcttcctcttctaaatacttcctaacttcagagagcaccagaagacacaagaaagcaaccgatagcctcccagtggtggaaaccaaagagcaatttcaagaagcagttccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaatccccctgggaaatc

SEQ ID NO: 136600 - DNA, 1224 bp, Homo sapiens
  Payload ID: 6740
  Gene Symbol: GAR1
  Gene Name: GAR1 homolog, ribonucleoprotein
  Uniprot ID: Q9NY12
  ENST ID: ENST00000226796
  CDS Start-End: 265-918
ggcctctctgttgtaaattagtggttaaggttatctattattgccacttttccagcgctaaaggctgttttggaaccagtgttgcttgttccgcgggtgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccgggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaagcatatttgaatttttaaaataaagtgttttattcccttaa

SEQ ID NO: 136601 - DNA, 1011 bp, Homo sapiens
  Payload ID: 6740
  Gene Symbol: GAR1
  Gene Name: GAR1 homolog, ribonucleoprotein
  Uniprot ID: Q9NY12
  ENST ID: ENST00000394631
  CDS Start-End: 49-702
ccgctgttatacgtcacttccacggctcagcgtcagggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaagcatatttgaatttttaaaataaagtgttttattcccttaagtt

SEQ ID NO: 136602 - DNA, 2164 bp, Homo sapiens
  Payload ID: 6741
  Gene Symbol: GSDMA
  Gene Name: gasdermin A
  Uniprot ID: Q96QA5
  ENST ID: ENST00000301659
  CDS Start-End: 119-1456
ataaagcagcctgtcctggcaagggatggtcatcctctcaacctacagacccagtgagccctaggccctcaccccagacccagctgctggataggacccagccccgctcccagagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactacacgctgctggatgtgcttgagcccggcagctcaccttcagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttcttcgccccattggggctacagggatccataaatcacaaggaggctgtaaccatccccaagggctgcgtcctggcctttcgagtgagacagctgatggtcaaaggcaaagatgagtgggatattccacatatctgcaatgataacatgcaaaccttccctcctggagaaaagtcaggagaggagaaggtcatccttatccaggcatctgatgttggggacgtacacgaaggcttcaggacactaaaagaagaagttcagagagagacccaacaagtggagaagctgagccgagtagggcaaagctccctgctcagctccctcagcaaacttctagggaagaaaaaggagctacaagaccttgagctcgcacttgaaggggctctagacaagggacatgaagtgaccctggaggcactcccaaaagatgtcctgctatcaaaggaggccgtgggcgccatcctctatttcgttggagccctaacagagctaagtgaagcccaacagaagctgctggtgaaatccatggagaaaaagatcctacccgtgcagctaaagctggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttagg

SEQ ID NO: 136603 - DNA, 547 bp, Homo sapiens
  Payload ID: 6741
  Gene Symbol: GSDMA
  Gene Name: gasdermin A
  ENST ID: ENST00000577447
  CDS Start-End: 72-547
attctttccagctgtgacatgagacaatccaggcatctctaagagctcctcctgcctcagagccggagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactacacgctgctggatgtgcttgagcccggcagctcaccttcagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggaagctggcagcagaccacccattcctgaaggagatgcaagatcaaggggagaacctgtatgtggtgatggaggtggtggagac

SEQ ID NO: 136604 - DNA, 1500 bp, Homo sapiens
  Payload ID: 6742
  Gene Symbol: GSDMB
  Gene Name: gasdermin B
  Uniprot ID: Q8TAX9
  ENST ID: ENST00000309481
  CDS Start-End: 72-1283
atctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 136605 - DNA, 1468 bp, Homo sapiens
  Payload ID: 6742
  Gene Symbol: GSDMB
  Gene Name: gasdermin B
  Uniprot ID: Q8TAX9
  ENST ID: ENST00000360317
  CDS Start-End: 1-1251
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaatattcatttcaggggcaaaacaaaatcctttccagaagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 136606 - DNA, 1626 bp, Homo sapiens
  Payload ID: 6742
  Gene Symbol: GSDMB
  Gene Name: gasdermin B
  Uniprot ID: Q8TAX9
  ENST ID: ENST00000394175
  CDS Start-End: 225-1409
gtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgagaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 136607 - DNA, 1427 bp, Homo sapiens
  Payload ID: 6742
  Gene Symbol: GSDMB
  Gene Name: gasdermin B
  Uniprot ID: Q8TAX9
  ENST ID: ENST00000394179
  CDS Start-End: 1-1212
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgtt

SEQ ID NO: 136608 - DNA, 1597 bp, Homo sapiens
  Payload ID: 6742
  Gene Symbol: GSDMB
  Gene Name: gasdermin B
  Uniprot ID: Q8TAX9
  ENST ID: ENST00000418519
  CDS Start-End: 132-1382
acaactttcagtttcattattttagcttcctgagattcagaggccaggaactgtgcagagatctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaatattcatttcaggggcaaaacaaaatcctttccagaagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgtt

SEQ ID NO: 136609 - DNA, 958 bp, Homo sapiens
  Payload ID: 6742
  Gene Symbol: GSDMB
  Gene Name: gasdermin B
  ENST ID: ENST00000522564
  CDS Start-End: 1-552
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaa

SEQ ID NO: 136610 - DNA, 1100 bp, Homo sapiens
  Payload ID: 6742
  Gene Symbol: GSDMB
  Gene Name: gasdermin B
  ENST ID: ENST00000524039
  CDS Start-End: 1-612
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaa

SEQ ID NO: 136611 - DNA, 1127 bp, Homo sapiens
  Payload ID: 6742
  Gene Symbol: GSDMB
  Gene Name: gasdermin B
  ENST ID: ENST00000523371
  CDS Start-End: 1-603
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaa

SEQ ID NO: 136612 - DNA, 1546 bp, Homo sapiens
  Payload ID: 6742
  Gene Symbol: GSDMB
  Gene Name: gasdermin B
  Uniprot ID: Q8TAX9
  ENST ID: ENST00000520542
  CDS Start-End: 108-1331
attattttagcttcctgagattcagaggccaggaactgtgcagagatctgtggggattctcacaacttccatttctggtgaacagctgaggtcagagaggaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaatattcatttcaggggcaaaacaaaatcctttccagaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgtt

SEQ ID NO: 136613 - DNA, 369 bp, Homo sapiens
  Payload ID: 6742
  Gene Symbol: GSDMB
  Gene Name: gasdermin B
  ENST ID: ENST00000468820
  CDS Start-End: 1-223
ggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttcc

SEQ ID NO: 136614 - DNA, 2714 bp, Homo sapiens
  Payload ID: 6743
  Gene Symbol: GSDMC
  Gene Name: gasdermin C
  Uniprot ID: Q9BYG8
  ENST ID: ENST00000276708
  CDS Start-End: 883-2409
ccacatgtaggcagttcagaggtgcttcccagggccctggcgctagtgcctgtccctcctgctgaagttgcctttcctggtgtccagtgattgaattctaaattcagcacatataccagaggaatacgagccaaagaagttgttccagctagagttgctgggaatccatgaatcaaagacttgctcagctagttctgtatgtgaaaggaaatgggtgtgactctgaggaagcctttttaattctgattcaggagatacataattagatgccacttgattttgttccacagactttttgctgaggacttgagagctaaggttctgtgatccagaactagttccagacttactcttctggaaatgaacagggccctcctgtgcttatttttccaggatactgcattggaaattgagtcagggacccattggtgagaagagaacagtgaacagaatcacattgatctggtcctggagtttgtctgacaatttctacttgaccgcaggaggtctgaagattggaaggggccctactcaattgtgctatttttctctcttttttttttttttgagacggagttgcccaggctggagtgcagcggcatggtctcagctcactgcaacctctgcctcccgggttcaagcagttctctgcctcagcctcccaagtagctgggattacaggtgcctgccaccattcctggctaatttttgtattttcagtagagacagggtttcaccatcttggcctggctgatcttgaactcctgacctcgtgatccaccggcctcagcctcccaaagtgctgggattacagacgtgagccaccgtgcccggccaatcctgctatttctctacaggacaaagggatatataatctgcaacatgccctccatgttggaacgcattagcaaaaatttggtcaaagagattggaagcaaagacctgacacctgtcaaatacctattgagtgccaccaaattacgtcagtttgttatattacgaaagaagaaggattctcgttcatcattttgggaacaatctgactatgttccagttgaattctccctcaatgacatcctggagccaagttcttcagtcctagaaactgttgtgacaggaccgttccacttcagtgacattatgatccagaagcataaggctgacatgggtgtgaatgttggtatagaagtgagtgtgtcaggggaggcctctgtggaccatggatgctccctcgagtttcaaattgttaccatcccatcaccaaacctggaagactttcaaaaaaggaaactgttggatccagagccatcatttctgaaggagtgccggaggagaggggacaacctgtacgtggtgacagaggctgttgaactgatcaacaatactgtgctgtacgatagcagtagtgtgaatattttagggaaaattgctctttggattacctatggcaagggtcaaggccaaggagagagtctcagagtgaagaagaaggcgctgactcttcagaaaggcatggtgatggcttataagagaaagcagctggttatcaaggagaaagccattctcatctcagatgatgatgaacagagaacctttcaagatgagtacgaaatttccgaaatggtaggctactgtgctgcgaggagtgaggggttgctaccatcatttcataccatctctccaaccctcttcaatgcctcatccaatgatatgaagttaaaaccagagctatttctgacacagcaatttttgagcgggcatttgccaaaatacgaacaagttcacatcctcccagtaggaagaatagaggaacccttctggcaaaatttcaagcatctacaagaggaggttttccagaaaataaagacactggctcagctctcaaaggatgttcaggatgtcatgttctacagtatcctggccatgctcagagacagaggggctctacaggacctgatgaacatgctggaattggacagctcaggtcatttggatggccctggtggtgccatcctaaagaaacttcaacaggattcaaaccatgcatggtttaacccaaaggaccccattctttatctccttgaagccataatggtgctgagtgacttccaacacgatttgctggcctgttccatggagaagaggatcctgcttcagcaacaggagctggtaaggagcatcctggagccaaacttcagatacccctggagcattcccttcaccctcaaacctgagctcctcgccccactccagagtgagggtttggccatcacctatggcctgctggaggagtgtggccttaggatggagctggataaccccaggtcaacctgggatgtagaagcaaagatgcccctgtctgccctctatgggactctctcgttgctgcagcagctggctgaggcctaagccctccctgatgggcagtcagtccagagatgctggccctcgcccagtctatgctgtgagtgtccttatgggtgcaagagatagggctgtgcctctctgcgtttccaggtggagtagagacagtaatgggtagagactttaggaaatgttttggggtggtggaatactctatatattgacaagagtttatatattgacaagagtttatatatttgtcaaaactcctcaaatagtatgttaaagacgtaagcgtttcactatgtataaattttacttcaaaataataaaaacaaatactgactcta

SEQ ID NO: 136615 - DNA, 1831 bp, Homo sapiens
  Payload ID: 6743
  Gene Symbol: GSDMC
  Gene Name: gasdermin C
  Uniprot ID: Q9BYG8
  ENST ID: ENST00000619643
  CDS Start-End: 1-1527
atgccctccatgttggaacgcattagcaaaaatttggtcaaagagattggaagcaaagacctgacacctgtcaaatacctattgagtgccaccaaattacgtcagtttgttatattacgaaagaagaaggattctcgttcatcattttgggaacaatctgactatgttccagttgaattctccctcaatgacatcctggagccaagttcttcagtcctagaaactgttgtgacaggaccgttccacttcagtgacattatgatccagaagcataaggctgacatgggtgtgaatgttggtatagaagtgagtgtgtcaggggaggcctctgtggaccatggatgctccctcgagtttcaaattgttaccatcccatcaccaaacctggaagactttcaaaaaaggaaactgttggatccagagccatcatttctgaaggagtgccggaggagaggggacaacctgtacgtggtgacagaggctgttgaactgatcaacaatactgtgctgtacgatagcagtagtgtgaatattttagggaaaattgctctttggattacctatggcaagggtcaaggccaaggagagagtctcagagtgaagaagaaggcgctgactcttcagaaaggcatggtgatggcttataagagaaagcagctggttatcaaggagaaagccattctcatctcagatgatgatgaacagagaacctttcaagatgagtacgaaatttccgaaatggtaggctactgtgctgcgaggagtgaggggttgctaccatcatttcataccatctctccaaccctcttcaatgcctcatccaatgatatgaagttaaaaccagagctatttctgacacagcaatttttgagcgggcatttgccaaaatacgaacaagttcacatcctcccagtaggaagaatagaggaacccttctggcaaaatttcaagcatctacaagaggaggttttccagaaaataaagacactggctcagctctcaaaggatgttcaggatgtcatgttctacagtatcctggccatgctcagagacagaggggctctacaggacctgatgaacatgctggaattggacagctcaggtcatttggatggccctggtggtgccatcctaaagaaacttcaacaggattcaaaccatgcatggtttaacccaaaggaccccattctttatctccttgaagccataatggtgctgagtgacttccaacacgatttgctggcctgttccatggagaagaggatcctgcttcagcaacaggagctggtaaggagcatcctggagccaaacttcagatacccctggagcattcccttcaccctcaaacctgagctcctcgccccactccagagtgagggtttggccatcacctatggcctgctggaggagtgtggccttaggatggagctggataaccccaggtcaacctgggatgtagaagcaaagatgcccctgtctgccctctatgggactctctcgttgctgcagcagctggctgaggcctaagccctccctgatgggcagtcagtccagagatgctggccctcgcccagtctatgctgtgagtgtccttatgggtgcaagagatagggctgtgcctctctgcgtttccaggtggagtagagacagtaatgggtagagactttaggaaatgttttggggtggtggaatactctatatattgacaagagtttatatattgacaagagtttatatatttgtcaaaactcctcaaatagtatgttaaagacgtaagcgtttcactatgtataaattttacttcaaaataataaaaacaaatactgactct

SEQ ID NO: 136616 - DNA, 1762 bp, Homo sapiens
  Payload ID: 6744
  Gene Symbol: GSDMD
  Gene Name: gasdermin D
  Uniprot ID: P57764
  ENST ID: ENST00000262580
  CDS Start-End: 150-1604
gttccgggagggcgtcctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 136617 - DNA, 511 bp, Homo sapiens
  Payload ID: 6744
  Gene Symbol: GSDMD
  Gene Name: gasdermin D
  ENST ID: ENST00000529854
  CDS Start-End: 368-511
gaactgagtgtggacagagcacctgtcctcgccagcgcccagctggaagctgagttatttgtggctgcagcattccaacgcacacaccaccagaaatccccttcagcatactggcctcagacctaccagggcagagaccttgtcttgtttgctgctagaacccaggatcgctggaaaatcacctagcagcagccaggtgcggtgactcacgcctgtaatcccagcactttggaaggccaaggcgggtggatagcaaggtcaagagatcgagaccagcctggccaacatgctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatgg

SEQ ID NO: 136618 - DNA, 2496 bp, Homo sapiens
  Payload ID: 6744
  Gene Symbol: GSDMD
  Gene Name: gasdermin D
  Uniprot ID: P57764
  ENST ID: ENST00000526406
  CDS Start-End: 884-2338
cttcccggctcggggattacctctctggctggtcccctcctccgtgctctgcgcgcctccaccctagcgcttgtcttggctcctagaaccaggggcctggacgctgctcagggcagaggcgccccctctgaggggctggcccctcagccgcactccgagacagccgcccccgggaccgcccttccttggagccccgccgcccgccgctcactctgcacacgcagcagaagggacgtggtgttccccaggctctggccccccaggacctgcgcggatctggcccagggcgcctcgccgacttccgtaaactgggcggagggatgaaccccgacccaggggacggaggcgctcgccctctcgctgcagggttctgccctcaacacttctggccccgcctgtgaatgggggccggagcgatggggcggggccggcctccctccctcctcccaggctgacctctgccctccttcgagcacttcccgttcggggtgatgattgaagaactgagtgtggacagagcacctgtcctcgccagcgcccagctggaagctgagttatttgtggctgcagcattccaacgcacacaccaccagaaatccccttcagcatactggcctcagacctaccagggcagagaccttgtcttgtttgctgctagaacccaggatcgctggaaaatcacctagcagcagccaggtgcggtgactcacgcctgtaatcccagcactttggaaggccaaggcgggtggatagcaaggtcaagagatcgagaccagcctggccaacatgctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 136619 - DNA, 691 bp, Homo sapiens
  Payload ID: 6744
  Gene Symbol: GSDMD
  Gene Name: gasdermin D
  ENST ID: ENST00000525208
  CDS Start-End: 1-691
cagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctgcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 136620 - DNA, 1800 bp, Homo sapiens
  Payload ID: 6744
  Gene Symbol: GSDMD
  Gene Name: gasdermin D
  ENST ID: ENST00000533063
  CDS Start-End: 44-1642
gagacggagtctcactctgtcgcccaggctggagtacaatggcatgatctcggctcactgcaacctacacctcccaggttcaagcgattctcttgcctcagcctcccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 136621 - DNA, 724 bp, Homo sapiens
  Payload ID: 6744
  Gene Symbol: GSDMD
  Gene Name: gasdermin D
  ENST ID: ENST00000533348
  CDS Start-End: 231-724
aagttgtttgtttgcttgtttgtttttgagacggagtctcactctgtcgcccaggctggagtacaatggcatgatctcggctcactgcaacctacacctcccaggttcaagcgattctcttgcctcagcctcccagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgca

SEQ ID NO: 136622 - DNA, 442 bp, Homo sapiens
  Payload ID: 6744
  Gene Symbol: GSDMD
  Gene Name: gasdermin D
  ENST ID: ENST00000525721
  CDS Start-End: 100-442
acttttagctctgggcacctccagctcctgctcgccggacggctcccagggagagcagacgcgccagacgcgccaccctcggggcgccgacggtcacgcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctcca

SEQ ID NO: 136623 - DNA, 1101 bp, Homo sapiens
  Payload ID: 6744
  Gene Symbol: GSDMD
  Gene Name: gasdermin D
  ENST ID: ENST00000534018
  CDS Start-End: 271-1101
cctccagctcctgctcgccggacggctcccagggagagcagacgcgccagacgcgccaccctcggggcgccgacggtcacggttcccgggccggtgctgttcccgcccccagctgccttctgggcccagcctccactttcagcagacccagcactcagaggcttcctggggcagctgcagcccctccacagtggcccaggtgccccctatcccagcggaggcccgctatggcctctgacccccaaagcctcagccttggacaggtggctcatggagctccaggcacagagaaggccctggaggacgcagctggggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctct

SEQ ID NO: 136624 - DNA, 576 bp, Homo sapiens
  Payload ID: 6744
  Gene Symbol: GSDMD
  Gene Name: gasdermin D
  ENST ID: ENST00000533888
  CDS Start-End: 116-576
cagaaggccccgcgccgcacacgggggcggaagctccaggcttcgggaaaggctgcccctggccagcccaggggcccggcctttggacctgggcttgggcttgactcccaggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcgg

SEQ ID NO: 136625 - DNA, 1762 bp, Homo sapiens; identical to SEQ ID NO: 136616
  Payload ID: 6744
  Gene Symbol: GSDMD
  Gene Name: gasdermin D
  Uniprot ID: P57764
  ENST ID: ENST00000615119
  CDS Start-End: 150-1604

SEQ ID NO: 136626 - DNA, 1800 bp, Homo sapiens; identical to SEQ ID NO: 136620
  Payload ID: 6744
  Gene Symbol: GSDMD
  Gene Name: gasdermin D
  ENST ID: ENST00000628703
  CDS Start-End: 44-1642

SEQ ID NO: 136627 - DNA, 691 bp, Homo sapiens; identical to SEQ ID NO: 136619
  Payload ID: 6744
  Gene Symbol: GSDMD
  Gene Name: gasdermin D
  ENST ID: ENST00000632705
  CDS Start-End: 1-691

SEQ ID NO: 136628 - DNA, 724 bp, Homo sapiens; identical to SEQ ID NO: 136621
  Payload ID: 6744
  Gene Symbol: GSDMD
  Gene Name: gasdermin D
  ENST ID: ENST00000633391
  CDS Start-End: 231-724

SEQ ID NO: 136629 - DNA, 2496 bp, Homo sapiens; identical to SEQ ID NO: 136618
  Payload ID: 6744
  Gene Symbol: GSDMD
  Gene Name: gasdermin D
  Uniprot ID: P57764
  ENST ID: ENST00000631751
  CDS Start-End: 884-2338

SEQ ID NO: 136630 - DNA, 1101 bp, Homo sapiens; identical to SEQ ID NO: 136623
  Payload ID: 6744
  Gene Symbol: GSDMD
  Gene Name: gasdermin D
  ENST ID: ENST00000631389
  CDS Start-End: 271-1101

SEQ ID NO: 136631 - DNA, 442 bp, Homo sapiens; identical to SEQ ID NO: 136622
  Payload ID: 6744
  Gene Symbol: GSDMD
  Gene Name: gasdermin D
  ENST ID: ENST00000632347
  CDS Start-End: 100-442

SEQ ID NO: 136632 - DNA, 576 bp, Homo sapiens; identical to SEQ ID NO: 136624
  Payload ID: 6744
  Gene Symbol: GSDMD
  Gene Name: gasdermin D
  ENST ID: ENST00000631550
  CDS Start-End: 116-576

SEQ ID NO: 136633 - DNA, 511 bp, Homo sapiens; identical to SEQ ID NO: 136617
  Payload ID: 6744
  Gene Symbol: GSDMD
  Gene Name: gasdermin D
  ENST ID: ENST00000631917
  CDS Start-End: 368-511

SEQ ID NO: 136634 - DNA, 716 bp, Homo sapiens
  Payload ID: 6745
  Gene Symbol: GIP
  Gene Name: gastric inhibitory polypeptide
  Uniprot ID: P09681
  ENST ID: ENST00000357424
  CDS Start-End: 102-563
agcaggctcagaaggtccagaaatcaggggaaggagacccctatctgtccttcttctggaagagctggaaaggaagtctgctcaggaaataaccttggaagatggtggccacgaagacctttgctctgctgctgctgtccctgttcctggcagtgggactaggagagaagaaagagggtcacttcagcgctctcccctccctgcctgttggatctcatgctaaggtgagcagccctcaacctcgaggccccaggtacgcggaagggactttcatcagtgactacagtattgccatggacaagattcaccaacaagactttgtgaactggctgctggcccaaaaggggaagaagaatgactggaaacacaacatcacccagagggaggctcgggcgctggagctggccagtcaagctaataggaaggaggaggaggcagtggagccacagagctccccagccaagaaccccagcgatgaagatttgctgcgggacttgctgattcaagagctgttggcctgcttgctggatcagacaaacctctgcaggctcaggtctcggtgactctgaccacacccagctcaggactggattctgcccttcacttagcacctgcctcagccccactccagaatagccaagagaacccaaaccaataaagtttatgctaagtcgagcccattgtgaaaatttattaaaatgactactgagcactaa

SEQ ID NO: 136635 - DNA, 1791 bp, Homo sapiens
  Payload ID: 6746
  Gene Symbol: GIPR
  Gene Name: gastric inhibitory polypeptide receptor
  Uniprot ID: P48546
  ENST ID: ENST00000263281
  CDS Start-End: 88-1347
aggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtaggcagagacccggccgccgcccccgccctctggcggcagcgcggggtacggcgccgcctctgagcgccatcgtctcacaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaaggggg

SEQ ID NO: 136636 - DNA, 1432 bp, Homo sapiens
  Payload ID: 6746
  Gene Symbol: GIPR
  Gene Name: gastric inhibitory polypeptide receptor
  Uniprot ID: P48546
  ENST ID: ENST00000304207
  CDS Start-End: 87-1379
ggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcagtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaact

SEQ ID NO: 136637 - DNA, 557 bp, Homo sapiens
  Payload ID: 6746
  Gene Symbol: GIPR
  Gene Name: gastric inhibitory polypeptide receptor
  ENST ID: ENST00000591322
  CDS Start-End: 506-557
tcctggcctcaagtgatccacccgcttcggcctcccaaagtgctgggattacaggcgtgagccaccgcgcccgggcccagattcgagttttgattatcgtttccactcccttttcttcccccaacaagtcctcctgataatttccagccaccccctccccaattttcttgaaggttttcagtctcccatagcaactccagtgggtggcttccaggcaccccaccccaagacttggaactggtttccaagctacccaagactcccgaacaacacgcaacagaccctcaaagtctctctggggcgcttctgggccacatggacctagcagcctgggagcgggggtcggtctgggggggtcctcccttctttcttttcctagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcct

SEQ ID NO: 136638 - DNA, 1414 bp, Homo sapiens
  Payload ID: 6746
  Gene Symbol: GIPR
  Gene Name: gastric inhibitory polypeptide receptor
  ENST ID: ENST00000585889
  CDS Start-End: 87-884
ggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctgggattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtg

SEQ ID NO: 136639 - DNA, 3289 bp, Homo sapiens
  Payload ID: 6746
  Gene Symbol: GIPR
  Gene Name: gastric inhibitory polypeptide receptor
  Uniprot ID: P48546
  ENST ID: ENST00000590918
  CDS Start-End: 100-1500
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggatgtcactcttacccaggttggtcttgaactcctgggctcaagcaatcctcccaccacgggtctctcaaagtgctgggattacaggcgtgagccaccgcacccggcttttttttttttttttaaacggagtctcactctgtcacccaggctggagtgcagtggtgcaatttcagctcactgcaccctccacctcccgagttcaagcctcccgggtagctgggattacaggcaccgccaccatgcctggctaatttttgcattttcagtagagatagggtttctccatgttggccaggctggtctcgaactcctgacctcaagtgatccacccacctcagcctcccaaagtgctgggattacaggcataagccaccatgcccggcccaaatgggctaatgttttaaacagatccttcttgtctgccctgtaggaggacaaattatcaggggcaggggtggaagctggagcccagaaaggaggggactgcaggtgggaagtgatggtggctggaccaggatggaggccactgaggggtatgaagcagtcggatttgaagctgtttaaaaggtggaggtgagaggatttcatgaaggagcacatgaggacacagcagcagagaggactccttggctttggatggtggagagactaaagatagagagattgggttcgggtagggggagaaccacgtgtgctctttggaaaggttaggctggcagtgtttgtaggacatgacaggacactgagtgtaagggtctggagctctcaggagaggggcgagctggagatagtaatgtgagaggcactgggtcctgagagggtgatttggtgtggaccggagcacaggtgaggcaaggcaggcctcgcagctgaaactttatatccagagcagccagggccactgctggctgcggagtgaggacgcatatccccactgtccttagatgggtggcccctggaacctgggagaatgagggggcatgctgacagtctcattgtggctggaccacctgtacatacacccacaagaccctcacccctaaatcctccccctacacatatgcacacttaagttaccgtatgggtgttgtcgagcattttccctggggtctgtggctccctggaccgacatgccccaaagctgaactcagccttttcaagcttgcggccctgctgcccaattcccctacaccctgccttgtgggttctcgcggggtgggggccttagggcaaggctcttgtaaataaagtataagaaacagttgc

SEQ ID NO: 136640 - DNA, 1518 bp, Homo sapiens
  Payload ID: 6747
  Gene Symbol: GIF
  Gene Name: gastric intrinsic factor (vitamin B synthesis)
  Uniprot ID: P27352
  ENST ID: ENST00000257248
  CDS Start-End: 49-1302
ttgcaaatcgcggtacctgtggatgagagacatagacgagagagtgagatggcctggtttgccctctacctcctgagccttctctgggctacagctgggactagtacccagacccagagttcatgctccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctcaacacaa

SEQ ID NO: 136641 - DNA, 1623 bp, Homo sapiens
  Payload ID: 6747
  Gene Symbol: GIF
  Gene Name: gastric intrinsic factor (vitamin B synthesis)
  ENST ID: ENST00000525058
  CDS Start-End: 47-193
gcaaatcgcggtacctgtggatgagagacatagacgagagagtgagatggcctggtttgccctctacctcctgagccttctctgggctacagctgggactagtacccagacccagagttcatgctgtgagtatgatgtttttccaaggaggtcagggaagcagttgccctggggaaggggctgtgacctctgacactgagtggttgaaaatagcaatcactataggaattccaaaatggccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctc

SEQ ID NO: 136642 - DNA, 470 bp, Homo sapiens
  Payload ID: 6748
  Gene Symbol: GAST
  Gene Name: gastrin
  Uniprot ID: P01350
  ENST ID: ENST00000329402
  CDS Start-End: 68-373
agagcagagacctgagaggcaccaggcccagccgtggcaccacacacctcccagctctgcagacgagatgcagcgactgtgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaacaatcctagaaccaagcttcagagcctagccacctcccaccccactccagccctgtcccctgaaaaactgatcaaaaataaactagtttccagtgga

SEQ ID NO: 136643 - DNA, 848 bp, Homo sapiens
  Payload ID: 6749
  Gene Symbol: GRP
  Gene Name: gastrin-releasing peptide
  Uniprot ID: P07492
  ENST ID: ENST00000256857
  CDS Start-End: 99-545
ccagcggctgcggcggcggagctcctccgaggtccgggtcaccagtctctgctcttcccagcctctccggcgcgctccaagggcttcccgtcgggaccatgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaa

SEQ ID NO: 136644 - DNA, 579 bp, Homo sapiens
  Payload ID: 6749
  Gene Symbol: GRP
  Gene Name: gastrin-releasing peptide
  Uniprot ID: P07492
  ENST ID: ENST00000420468
  CDS Start-End: 1-426
atgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagc

SEQ ID NO: 136645 - DNA, 607 bp, Homo sapiens
  Payload ID: 6749
  Gene Symbol: GRP
  Gene Name: gastrin-releasing peptide
  ENST ID: ENST00000456142
  CDS Start-End: 1-290
ggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaaggg

SEQ ID NO: 136646 - DNA, 405 bp, Homo sapiens
  Payload ID: 6749
  Gene Symbol: GRP
  Gene Name: gastrin-releasing peptide
  ENST ID: ENST00000530323
  CDS Start-End: 1-107
caatcagcagccttcgtgggattcagaggatagcagcaacttcaaagatactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgt

SEQ ID NO: 136647 - DNA, 824 bp, Homo sapiens
  Payload ID: 6749
  Gene Symbol: GRP
  Gene Name: gastrin-releasing peptide
  Uniprot ID: P07492
  ENST ID: ENST00000529320
  CDS Start-End: 95-511
cggctgcggcggcggagctcctccgaggtccgggtcaccagtctctgctcttcccagcctctccggcgcgctccaagggcttcccgtcgggaccatgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaa

SEQ ID NO: 136648 - DNA, 1929 bp, Homo sapiens
  Payload ID: 6750
  Gene Symbol: GRPR
  Gene Name: gastrin-releasing peptide receptor
  Uniprot ID: P30550
  ENST ID: ENST00000380289
  CDS Start-End: 399-1553
ccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctctcatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcattccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagccatcaagtcttaagtttttcatttcaacttgtgaacgtttcttctgatgtgaagcaaaccttcccttttcagaaaagggaacaagtagaaaattattttttaagcctcaagccctgttaaatggtcgtggccaattatgtcatagaaactgtatgaacaaccagatttacatagcagagaaatcatacattgaatgcttactt

SEQ ID NO: 136649 - DNA, 814 bp, Homo sapiens
  Payload ID: 6751
  Gene Symbol: GKN1
  Gene Name: gastrokine 1
  Uniprot ID: Q9NS71
  ENST ID: ENST00000377938
  CDS Start-End: 64-663
ataacacctagtttgagtcaacctggttaagtacaaatatgagaaggcttctcattcaggtccatgcttgcctactcctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattg

SEQ ID NO: 136650 - DNA, 800 bp, Homo sapiens
  Payload ID: 6752
  Gene Symbol: GKN2
  Gene Name: gastrokine 2
  Uniprot ID: Q86XP6
  ENST ID: ENST00000328895
  CDS Start-End: 110-664
ccaaagtgatcatttgaaaaagagatatccacatcttcaagcccatataaaggatagaagctgcacagggcagctttacttactccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttataga

SEQ ID NO: 136651 - DNA, 1498 bp, Homo sapiens
  Payload ID: 6752
  Gene Symbol: GKN2
  Gene Name: gastrokine 2
  ENST ID: ENST00000481498
  CDS Start-End: 20-505
ccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacgtgagtaccaataagtcattcactcaccaaatattttctgaaagctactatgtgccaggtgctctgttgggtgccaagtgaaatgcaaataaatgggaacagtactcagttcagtttgctttgggaattaattacatgccatgtgtgtaaattgtgctaaattttaggaatacagaaatgaattaaacgtctccagggaacacatagtctagtgaagaagctgacaagtgaaaagagaggatggagtaaaggatttctggatgccaatgaaaaactactcgattcttgtatactttcatatgtaagaatttcaagtagcaaaaagtcatctgggcccttagaatagcatattttgaagataataagaaggaagtcactaagaaatgctctcaggatctagaatagaattggtataggaaagaggaggccaagcggacttacagacagggagtaaaaaccctgattcatctgggtaacatatgccactgcagatattactgtcatttttatacaaagtttctaaatgtggcagagcaaccagagtgaaagaggtcgggccaactgatgatgaacacaacaaaggaaatttctcagagtactggaaggtagataaagaagagtttatgtttattatatatctactgcccagaaaaaaattttaagtactcattcataaagtaaataaaggcacataggtatgccattgacacagaatggcataatatcactgggattgagccaaccagcacttccaaaagttgtcagttttatttaagctaatgtattattattctaataattccaataatatattttttaatgctctttctctgaaaaattttcccttttccagataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaa

SEQ ID NO: 136652 - DNA, 1092 bp, Homo sapiens
  Payload ID: 6753
  Gene Symbol: GBX1
  Gene Name: gastrulation brain homeobox 1
  Uniprot ID: Q14549
  ENST ID: ENST00000297537
  CDS Start-End: 1-1092
atgcagcgggccggaggcggtagcgcccctgggggcaacggcgggggcggcggcgggggcccgggcactgccttctccatcgactccctaatcgggccgccgccgccgcgctccggccacttgctgtacaccggctaccccatgttcatgccctaccggccgctcgtgctgccgcaggcgctggcccctgcgccgctgcccgctggcctcccgcccctcgccccgctagcctctttcgccggccgccttaccaacaccttctgcgcggggctgggtcaggctgtgccctcgatggtggcgctgaccaccgcgctgcccagcttcgcggagccgcccgacgctttctacgggccccaggagctcgccgccgccgctgccgccgccgccgccactgccgcccgaaacaaccccgagccaggcggccgacgcccagagggtgggctggaagctgatgagctgctgccggcccgggagaaagtggcagagcccccaccacctccgcctccgcacttctcagagacttttccaagtctgcccgcagaggggaaggtgtacagctcagatgaggagaagctggaggcatcagcaggagacccagcaggcagcgaacaggaggaagagggctcaggcggtgacagcgaggatgacggtttcctggacagttctgcagggggcccaggggctcttctgggacctaaaccgaagctaaagggaagcctggggactggagctgaggagggggcaccggtgacagcaggggtcacagctcctggggggaaaagccgacggcgccgcacagcatttaccagcgagcagcttttggaattggagaaggaatttcattgcaagaaatacctgagcttgacagagcgctctcagatcgcccacgccctcaagctcagtgaggtgcaggtcaagatctggtttcagaatcgacgggccaagtggaagcgcatcaaagctggcaatgtgagcagccgttctggggagcccgtaagaaaccccaagattgttgtccccatacctgtgcatgtcaacaggtttgctgtgcggagccagcaccaacaaatggagcagggggcccggccctga

SEQ ID NO: 136653 - DNA, 2123 bp, Homo sapiens
  Payload ID: 6754
  Gene Symbol: GBX2
  Gene Name: gastrulation brain homeobox 2
  Uniprot ID: P52951
  ENST ID: ENST00000306318
  CDS Start-End: 399-1445
ccgccggagataagtacgccggcttcgcgcgctccccagcggcccgcgggaggcgacggacggcgggacggacggacggacggcagcttaccggggccgagggccaaacccgcgaagcgcgcgggctccgacgggcaagcggcggacgggggctccggcgagccctcggggcccgggcgccctctccactccggggcgcacggcctcaccccgcacaccccctgcacccgcccggcatgcagcgggcccaggactgaggggcggaggcgtctgctctccgggtcccgctcggcccctgcccggcgctcccggcggtgctcccggcgtccggcgggcttcccggcggcggcgcggcgcggggacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcgctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcgtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactggatctcagctgcagtattttgaaagttataggacttaattacccagtaatttctccactcattccagaagaaaacaaaacctctgctgtaatctgcgcggttagcagccacctttccatacttttccaaaggtaaacgtgaaacccaagaacaagcactggggtttaaactgattttggtttgcgttctggctttttgagttgactgaaaagcagacattgttaggcagcctggaaattcgctttgctttgctttgcttttgcctggctttggtttcccctggggttgcctatcctatctgagccatgtgaagcacgtctccgttgtgttaatttatttcaatgtagcttattttcttataagttatgacatttaaacaatttcagtcttgtgaataataaaaaggagagagggggggaaaaagaccaa

SEQ ID NO: 136654 - DNA, 1307 bp, Homo sapiens
  Payload ID: 6754
  Gene Symbol: GBX2
  Gene Name: gastrulation brain homeobox 2
  ENST ID: ENST00000551105
  CDS Start-End: 39-707
gacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcgctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcggccgcctctgccgctccgcggtgacctggggttccggtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccaca

SEQ ID NO: 136655 - DNA, 1140 bp, Homo sapiens
  Payload ID: 6755
  Gene Symbol: GATA1
  Gene Name: GATA binding protein 1 (globin transcription factor 1)
  ENST ID: ENST00000376665
  CDS Start-End: 93-1097
ggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaa

SEQ ID NO: 136656 - DNA, 1497 bp, Homo sapiens
  Payload ID: 6755
  Gene Symbol: GATA1
  Gene Name: GATA binding protein 1 (globin transcription factor 1)
  Uniprot ID: P15976
  ENST ID: ENST00000376670
  CDS Start-End: 112-1353
caaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctg

SEQ ID NO: 136657 - DNA, 3367 bp, Homo sapiens
  Payload ID: 6756
  Gene Symbol: GATA2
  Gene Name: GATA binding protein 2
  Uniprot ID: P23769
  ENST ID: ENST00000341105
  CDS Start-End: 333-1775
gagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcgggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaa

SEQ ID NO: 136658 - DNA, 2525 bp, Homo sapiens
  Payload ID: 6756
  Gene Symbol: GATA2
  Gene Name: GATA binding protein 2
  Uniprot ID: P23769
  ENST ID: ENST00000430265
  CDS Start-End: 252-1652
ggcagctggcgccagggcggccggaggatgccgaggggccggagccgggagggcccgaggccgaggcgcactctacccccagctcctaccctgtaagccccgccagcctccggacgtgctgtccctgggcccgtcgccctcggggctcccgccggaactccttcactctcagaggccgagtccctcccctccccacggctgcgtgtggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaa

SEQ ID NO: 136659 - DNA, 1878 bp, Homo sapiens
  Payload ID: 6756
  Gene Symbol: GATA2
  Gene Name: GATA binding protein 2
  Uniprot ID: P23769
  ENST ID: ENST00000487848
  CDS Start-End: 436-1878
actgggtcaagcacagccctgagcggccgcgtgtccgaggcccaggtgccctctagagccctgtagttcctgcccctctctgcccctctcggctcctgctgttccgccgctgtcgtccgaaccatcccaacccccagtccacccagacagcgcccgagctaggggagggaacggtctgggagtcggcagctggcgccagggcggccggaggatgccgaggggccggagccgggagggcccgaggccgaggcgcactctacccccagctcctaccctgtaagccccgccagcctccggacgtgctgtccctgggcccgtcgccctcggggctcccgccggaactccttcactctcagaggccgagtccctcccctccccacggctgcgtgtggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctag

SEQ ID NO: 136660 - DNA, 844 bp, Homo sapiens
  Payload ID: 6756
  Gene Symbol: GATA2
  Gene Name: GATA binding protein 2
  ENST ID: ENST00000492608
  CDS Start-End: 395-844
gtcgagcgcgggtccctctttattggccagctgggcgccctgctacttggcgtcgcatttctctctcccaggcgggttcgtttccgccagagaatgcagcagtcccgcatcctacgcaggacctgcaaccgaggtggaggcttcggtcaagccggctcctgcctgcgttgtcgaggaaggcaaccccaaggcctgaaaggacctggcagaactcctgtttcctttttttcctctacaccggattgcgggcaaggaggctggttcgggtctcccgaggcccctgctcaagcactccttaaccgtcctgctaagcccctctgtgcggcgattttctgagctgccgagcgggggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcggggga

SEQ ID NO: 136661 - DNA, 563 bp, Homo sapiens
  Payload ID: 6756
  Gene Symbol: GATA2
  Gene Name: GATA binding protein 2
  ENST ID: ENST00000498200
  CDS Start-End: 540-563
ggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcggcttgaactccgcgttgctccaaccacgaggggaaaggccccgcgttcagggaccccgtgtgtggcgaacgctcctttaccggaaaacaaggaaggaaattcgttgttttggaaaaagcctcctctcccgaggtcgggaacatctggtggtgagctccaggtctacgcaggcaccccgtgctaggattcgtttatgagcaggcaggattcgagaaccagggccgttgccgtctgcacccagaccctgagccgccgccgccggccatggaggtggcgcccgagcagccg

SEQ ID NO: 136662 - DNA, 2654 bp, Homo sapiens
  Payload ID: 6757
  Gene Symbol: GATA3
  Gene Name: GATA binding protein 3
  Uniprot ID: P23771
  ENST ID: ENST00000346208
  CDS Start-End: 456-1787
gagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggc

SEQ ID NO: 136663 - DNA, 3078 bp, Homo sapiens
  Payload ID: 6757
  Gene Symbol: GATA3
  Gene Name: GATA binding protein 3
  Uniprot ID: P23771
  ENST ID: ENST00000379328
  CDS Start-End: 569-1903
ctgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaacta

SEQ ID NO: 136664 - DNA, 3414 bp, Homo sapiens
  Payload ID: 6758
  Gene Symbol: GATA4
  Gene Name: GATA binding protein 4
  Uniprot ID: P43694
  ENST ID: ENST00000335135
  CDS Start-End: 559-1887
ggacttggaggcggccggcgcaggggccgcgagaggcttcgtcgccgctgcagctccgggggctcccaggggagcgtgcgcggaacctccaggcccagcaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctctttc

SEQ ID NO: 136665 - DNA, 1010 bp, Homo sapiens
  Payload ID: 6758
  Gene Symbol: GATA4
  Gene Name: GATA binding protein 4
  ENST ID: ENST00000528027
  CDS Start-End: 661-1010
cgcaggggccgcgagaggcttcgtcgccgctgcagctccgggggctcccaggggagcgtgcgcggaacctccaggcccagcagttatgaaagaaaaaaaattacattatcttgaagaactgcaggagttgagtattccagaaaatgcaatgaaataggtcagctacttgattttaaaagtcaaatactggatcttttattaaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccct

SEQ ID NO: 136666 - DNA, 2614 bp, Homo sapiens
  Payload ID: 6758
  Gene Symbol: GATA4
  Gene Name: GATA binding protein 4
  ENST ID: ENST00000528712
  CDS Start-End: 379-1089
acaacgtctccctcccacccggctgagaacagcctggaatccctgtgcagagtttgcctcacaccaggccttgagcagccgcagggacgccgctccccaccgcggggacgcatcctgctctgcaccctggttctcggcgctgcgcccgcggaggctcgtgcagggcaggctgcccgtgcgggtgaggactgagtgccgcgcagggaaggagtatcgcagaccggcgcccaggcccagcgggggaatccaagggccgtgttgcaggactcggcattcgttctgcgcgggtcaccttgaatgtctgtccggatccctcgcggcagggccgcagaggcgcgtccatatcttggaggaattcgttccatagaatgagtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctctt

SEQ ID NO: 136667 - DNA, 686 bp, Homo sapiens
  Payload ID: 6758
  Gene Symbol: GATA4
  Gene Name: GATA binding protein 4
  ENST ID: ENST00000526716
  CDS Start-End: 160-686
agtcagcgccctagggccgagttgctgggccggggacccgagccgcgagctggggacttggaggcggccggcgcaggggccgcgagaggcttcgtcgccgctgcagctccgggggctcccaggggagcgtgcgcggaacctccaggcccagcagtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtccca

SEQ ID NO: 136668 - DNA, 1459 bp, Homo sapiens
  Payload ID: 6758
  Gene Symbol: GATA4
  Gene Name: GATA binding protein 4
  Uniprot ID: P43694
  ENST ID: ENST00000532059
  CDS Start-End: 81-1412
gccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttgga

SEQ ID NO: 136669 - DNA, 832 bp, Homo sapiens
  Payload ID: 6758
  Gene Symbol: GATA4
  Gene Name: GATA binding protein 4
  ENST ID: ENST00000526974
  CDS Start-End: 764-832
cgcggcctctgcgcctcagccgacctccaccgcggcagggacgcatcctgctctgcaccctggttctcggcgctgcgcccgcggaggctcgtgcagggcaggctgcccgtgcgggtgaggactgagtgccgcgcagggaaggagtatcgcagaccggcgcccaggcccagcgggggaatccaagggccgtgttgcaggactcggcattcgttctgcgcgggtcaccttgaatgtctgtccggatccctcgcggcagggccgcagaggcgcgtccatatcttggaggaattcgttccatagaatgaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggcccc

SEQ ID NO: 136670 - DNA, 877 bp, Homo sapiens
  Payload ID: 6758
  Gene Symbol: GATA4
  Gene Name: GATA binding protein 4
  ENST ID: ENST00000532977
  CDS Start-End: 830-877
caacgtctccctcccacccggctgagaacagcctggaatccctgtgcagagtttgcctcacaccaggccttgagcagccgcagggacgccgctccccaccgcggggacgcatcctgctctgcaccctggttctcggcgctgcgcccgcggaggctcgtgcagggcaggctgcccgtgcgggtgaggactgagtgccgcgcagggaaggagtatcgcagaccggcgcccaggcccagcgggggaatccaagggccgtgttgcaggactcggcattcgttctgcgcgggtcaccttgaatgtctgtccggatccctcgcggcagggccgcagaggcgcgtccatatcttggaggaattcgttccatagaatgaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggt

SEQ ID NO: 136671 - DNA, 1982 bp, Homo sapiens
  Payload ID: 6758
  Gene Symbol: GATA4
  Gene Name: GATA binding protein 4
  ENST ID: ENST00000622443
  CDS Start-End: 1-1326
atgtatcagagcttgccatggccgccaaccacgggccgccccccggtgcctacgaggcgggcggccccggcgccttcatgcacggcgcgggcgccgcgtcctcgccagtctacgtgcccacaccgcggtgccctcctccgtgctgggcctgtcctacctccagggcggaggcgcgggctctgcgtccggagggcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctcc

SEQ ID NO: 136672 - DNA, 2595 bp, Homo sapiens
  Payload ID: 6759
  Gene Symbol: GATA5
  Gene Name: GATA binding protein 5
  Uniprot ID: Q9BWX5
  ENST ID: ENST00000252997
  CDS Start-End: 63-1256
ccaccgccaccgccgtgccctgccgccctccctgcccgctggtcaagaccacgcctgggaggatgtaccagagcctggcgctggccgcgagcccccgccaggccgcctacgccgactcgggctccttcctgcacgctccgggcgccggctctccgatgtttgtgccgccggcgcgcgtcccctcgatgctgtcctacctgtccgggtgtgagccgagcccgcagccccccgagctcgctgcgcgccccggctgggcgcagacagccaccgcggattcgtcggccttcggcccgggcagtccgcaccccccagccgcgcacccgcccggggccaccgccttccctttcgcgcacagcccctcggggcccggcagcggcggcagcgcggggggccgagacggcagtgcctaccagggcgcgctgttgcctcgagaacagttcgcggccccgcttgggcggccggtggggacctcgtactccgccacctacccggcctacgtgagccccgacgtggcccagtcctggactgccgggcccttcgatggcagcgtcctgcacggcctcccaggccgcaggcccaccttcgtgtccgacttcttggaggagttcccgggtgagggtcgtgagtgtgtcaactgcggggccctgtccacaccgctgtggcgccgagacggcaccggccactacctgtgcaatgcctgcggcctctaccacaagatgaatggcgtcaaccggccgctcgttcggcctcagaagcgcctgtcctcgtcccgccgcgccggcctctgctgcaccaactgccacacgaccaacaccacgctgtggcggcggaactcggagggggagcccgtgtgcaatgcctgcggcctctacatgaagctgcacggggtgccgcggcctctggctatgaagaaggaaagcatccagacacggaagcggaagccaaagaccatcgccaaggccaggggctcctcaggatccacaaggaatgcctcggcctccccatctgctgtcgccagcactgacagctcagcagccacttcgaaagccaagcccagcctggcgtccccagtgtgccctgggcccagcatggccccccaggcctctggccaggaggatgactctcttgcccccggccacttggagttcaagttcgagcctgaggactttgccttcccctccacggccccaagcccccaggctggcctcaggggggctctgcgccaagaggcctggtgtgcgctggccttggcctaggtccccaggccagcccatgtcaggggaacagcctggaacagaccacccactgagtcacctccgtgcctgctttgctccagcacagcagagaccagcaggccccccaacccagagactgggtctgctggagtctccacacagtggtggggaggccttctggacagacggcagtcgggccccagagcaagaaggctggtgagggaagggctcagcttcccaccccacgtacagcaagggactccccaggtgcggcccaaggctccggaccacactggccccctgcggcggaggccaacgcagggcaccaccaccaccaacttgaattccgtcatcaatgctcaccgtcaatatgtttacaagttgtagcagttgggggaaaacagtcaacctcccagtgtaaaaccaagattcccagtgaagcacctgaggccaagcaggggagaggaatgaggggagcagctggacatgggcctcctgaggcctcggggctgtccttcattgcccacatggatagacggagctgtggtgcagagaacttttcccgcaacaggtgcaggactgccagggatcggagtgcgggccgcgcacggtgccaggattccgccgaggggaagccgctcacattgcagtcatcacagacttacgcacttgtttggacagtttttccagaggggatgggaaagggccttgttctagctgaatctgtgtatcatgaccatttctgacaggcagaatgaattgtctggtagccctgtcctgacccatccaagcgctgttggggctggtggtgacgtggtcacatgtcctggcatatctggggccacgcagtttagtctcttgtcccaggagaattgttagtgacccctctttctcttgcaagccccctccacactgggttggatgataccttaatgagtgacgctggcgagaggcaccctacccgacgcagctgtgaatggccggtgatgtatgtcaggaggccacagggagcagaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcgggtccggtcattctgaaactgtccctccagaggttcttccagccccacttctatgcgatgtcatcttttctaaaagagacaaatgaagccacagggaaagtgaaataaagccttgaacctca

SEQ ID NO: 136673 - DNA, 3770 bp, Homo sapiens
  Payload ID: 6760
  Gene Symbol: GATA6
  Gene Name: GATA binding protein 6
  Uniprot ID: Q92908
  ENST ID: ENST00000269216
  CDS Start-End: 278-2065
gacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtg

SEQ ID NO: 136674 - DNA, 2057 bp, Homo sapiens
  Payload ID: 6760
  Gene Symbol: GATA6
  Gene Name: GATA binding protein 6
  Uniprot ID: Q92908
  ENST ID: ENST00000581694
  CDS Start-End: 213-2000
attgatctccacgcccggggcagaaataggatctttgagaagtctcaaatgggatctttgagaagtcagatcccatttgaactagaaaaaggagtggaggcgaggtagcgtgcagcctacgctcttgttaacccgtcgatctcctaccatacccgtctcccccaccccacctcaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtc

SEQ ID NO: 136675 - DNA, 3361 bp, Homo sapiens
  Payload ID: 6761
  Gene Symbol: GATAD1
  Gene Name: GATA zinc finger domain containing 1
  Uniprot ID: Q8WUU5
  ENST ID: ENST00000287957
  CDS Start-End: 278-1087
tccgcgtcccccccaccccggccagatccctttcccagtcctgcttcccagtgcctcgggccagggaatcctggcctccgcctgcggagccggcggaacccgcttcccgcctccacggggcagcgccagcggcctggtcctttcaccggcagctccgtgccgacgctctcaccgctcttcctatcgccgggagtggcgggccgaccagggggcggccgggctaccgtccgccattcccgtgtctctgcgcccgcgggggccgcccgagccggccaccatgccgctgggcctgaagcccacctgcagcgtatgcaagaccacgtcgtcctccatgtggaagaagggagcgcagggggagatcctctgccatcattgcactggccggggcggcgcgggcagcgggggcgcaggctcgggggcggctggagggactgggggcagcggcggcggcggcttcggcgcggcgaccttcgccagcacctccgccacccctccgcagagcaacgggggcgggggcggcaagcagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaaaaaaaaaaaaaaaaaaaggctgggcacagtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacaggtagtatctatttttctccattatttatttctagaaactcataaaatggattgtatttttctataagaacaaaatattaattaaggtatagatgactgaccaagggcttaatcaaataaaatgactaacagcatctatcataaagccacacaagccttatgttctcatctcaaaaatgctgtgacagctttttggctgctttaaccataagaaaaatgattggtggatgattttattagcccaggcttttaaaaactttcatctaggccacgtgcggtggctcatgcctgtaatcccggcactttgggaggcctgagtggatggatcacttgaggtcaggagttcaggaccagcctggccaacatgatgaaaccctgtctctactaaatatacaaaaattagttgggtgttatggtgcatgcctgtaatcccagctactcgggaggctgaggcaggagaattgcttgaactcgggaggtggagattgcagtaagccgagatcgtgccactgcactccagcctgggtgatagagcaagactgtctcaaaaaagaaaaaaaagaaaaaattttaatttaatccttctgtagaaacaggcattcagaaccattccattgatcttaataaagctgctctttactgtttctagtcaaaaatgagacttcgatcaaaccataagattttatactgcagatagtcagcttcaccaaagccgcagaggaaacatgtcgagatcaggcttcctgcttgatagtctcttgactaccattaaaacgaatattgggaggtcatgaaagtcattggtaggccattagcattgatatctttaaaacatctaccctaaaccatctgctatggacccataataagaggcctgttgtatatgaaattgtctagaattcaggtgcaggtctttgccggttaagtaagggagcaacacgtaaaatgggagaggagtggggtgtactcacttgcctcctcttttgtcctgatttaaccagcatttttcaaccctgggaaaatttgcagaatctaagttgattgtaatgattttgagctgcagcagctttaactcttaccctttttccacatagttatggtgtttgagttggaaagaaacaactataggtagctacacgtacataattatctctttattcacaaagggtatagtaaaattgattgtaaataactttctaagtgccaatattcaaaacttttggattaaaatgtatttttcaccgtgca

SEQ ID NO: 136676 - DNA, 5510 bp, Homo sapiens
  Payload ID: 6762
  Gene Symbol: GATAD2A
  Gene Name: GATA zinc finger domain containing 2A
  Uniprot ID: Q86YP4
  ENST ID: ENST00000358713
  CDS Start-End: 156-2057
gtgcataccaagcccatactgtttgctctacactgaaaatgaagatgaatggtgaaaaaaagtttctgccattgagagcttaacattgagttgcagtgagagatgaagctcctgagtggcacggagattgttgccagggctctggtgagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaa

SEQ ID NO: 136677 - DNA, 5671 bp, Homo sapiens
  Payload ID: 6762
  Gene Symbol: GATAD2A
  Gene Name: GATA zinc finger domain containing 2A
  Uniprot ID: Q86YP4
  ENST ID: ENST00000360315
  CDS Start-End: 313-2214
gggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgg

SEQ ID NO: 136678 - DNA, 5776 bp, Homo sapiens
  Payload ID: 6762
  Gene Symbol: GATAD2A
  Gene Name: GATA zinc finger domain containing 2A
  Uniprot ID: Q86YP4
  ENST ID: ENST00000404158
  CDS Start-End: 419-2323
attctatgggttttcttcagtccctggacagatggagtcttattctgtcgccaggctggagtgcagtggtatgatcttggctcactgcagcctccgcctcccaggttcaagcgattctcctgcctcagcctgctgagtagctgcgactacaggcgtgcgtcaccacacccagctaatttttgtatttttaatagggacatttttagtatttttagggttttaccatgttggccaggatggactcgatctcctgacctcatgatccacctgcctcagcctctcaaagtgctgggactacaggtgtgagccaccgtacccagcctcgaaggttggtcagcacattgtctcaagtagccttttgatgtcactgtggccatggccaactggtaggaccagcaccccataccccgaagccagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaa

SEQ ID NO: 136679 - DNA, 570 bp, Homo sapiens
  Payload ID: 6762
  Gene Symbol: GATAD2A
  Gene Name: GATA zinc finger domain containing 2A
  ENST ID: ENST00000432704
  CDS Start-End: 153-570
agagtgcggatattctatgggttttcttcagtccctggacaggtggggtcatcctaggacccctgcaatctttaggggatttagggagaaacagtgtccaggaacatctgaggtctctgttcccgtgcattgcttggggattgaagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaag

SEQ ID NO: 136680 - DNA, 655 bp, Homo sapiens
  Payload ID: 6762
  Gene Symbol: GATAD2A
  Gene Name: GATA zinc finger domain containing 2A
  ENST ID: ENST00000417582
  CDS Start-End: 123-655
gcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaa

SEQ ID NO: 136681 - DNA, 729 bp, Homo sapiens
  Payload ID: 6762
  Gene Symbol: GATAD2A
  Gene Name: GATA zinc finger domain containing 2A
  ENST ID: ENST00000457895
  CDS Start-End: 233-729
ccgggctccatgtgtgcggccgaggggcgcattatctggccggcggcgcgggcgggcgggcggaccggcgcagcgagcgccgcgggcccgggcggccccacaggcggaacgagcgcgcgcggcccggcgtccccggcccctccgccgcccggccccgcgggcgaccccggaccagcagcccccgtaacctgcgcgctgccctagggcccggccgacccgcggcccgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcg

SEQ ID NO: 136682 - DNA, 565 bp, Homo sapiens
  Payload ID: 6762
  Gene Symbol: GATAD2A
  Gene Name: GATA zinc finger domain containing 2A
  ENST ID: ENST00000444839
  CDS Start-End: 286-565
atgtgtgtgctgcaggtacagggcagtggcacgttgatgggccaggcctcactctactcaaagtgtacctcactggcaaccaaagggttaaatgtgatccccagtccccactccccagaggtgagcagggagtgaggagacctcccttccctgaaggggagaagctggggttaactcgagtcaccacagcatagggctagtcccaggccccgaccctgctcctggaacagtgcagtcaccgccctcctggattccagacattgcaggtgctgaaaatcccaaagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagt

SEQ ID NO: 136683 - DNA, 3480 bp, Homo sapiens
  Payload ID: 6762
  Gene Symbol: GATAD2A
  Gene Name: GATA zinc finger domain containing 2A
  ENST ID: ENST00000418032
  CDS Start-End: 7-306
ttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacga

SEQ ID NO: 136684 - DNA, 504 bp, Homo sapiens
  Payload ID: 6762
  Gene Symbol: GATAD2A
  Gene Name: GATA zinc finger domain containing 2A
  ENST ID: ENST00000429242
  CDS Start-End: 125-504
gcccacgcatccagtatgtgcagcacacctgctctgtgactgacactcttgcagaagtggggccacttcagggacatggacaaggtgttgtacctgctgtcacagagcctgttatctgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaagga

SEQ ID NO: 136685 - DNA, 1652 bp, Homo sapiens
  Payload ID: 6762
  Gene Symbol: GATAD2A
  Gene Name: GATA zinc finger domain containing 2A
  ENST ID: ENST00000609040
  CDS Start-End: 170-457
cgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggaccttt

SEQ ID NO: 136686 - DNA, 640 bp, Homo sapiens
  Payload ID: 6762
  Gene Symbol: GATAD2A
  Gene Name: GATA zinc finger domain containing 2A
  ENST ID: ENST00000494516
  CDS Start-End: 409-640
gtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcggttggtcagcacattgtctcaagtagccttttgatgtcactgtggccatggccaactggtaggaccagcaccccataccccgaagccagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctgg

SEQ ID NO: 136687 - DNA, 7478 bp, Homo sapiens
  Payload ID: 6763
  Gene Symbol: GATAD2B
  Gene Name: GATA zinc finger domain containing 2B
  Uniprot ID: Q8WXI9
  ENST ID: ENST00000368655
  CDS Start-End: 245-2026
agcgtccttgtttgtgtggtgccgccgccgccggtgcagccgtcgccgccgccgctgcccccgtctgtaccgcagtgtctgctccgcccgcccgccccggtccggcccgcccccctcccctacccccgtccctagtcccgtcagcagggtctggatcccctgtgccgtcgcctcttcctttttcgacgcctccgccgccgcctgaggaggcgagctagccgggagttacaccgccaccgccaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaaagggtttctggggaaggggagggggtagggaggcagggctgtggagggtgggtaggggagtgggccgggcccagcacactgagactggcagctgctccaaccccatccctccttagagatgccacctcccccaccacccacccctaatttgtgccttgcctccccaccctggagtagtccctccgggtcaccagcactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaagaaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttctgcattgtgtttgggaaataaaatgaaaaaactaagaccaatagaaactggttttcaaaaaggcaaatacactcccatctgtttcagatgctgctgagcatttcagcagtgacagattcaaataataagctaatttttggagaaaggattaaaagaaaaaaaaactttgtaatatttatcacttgcaagctatgtttaataaagaaaggaatggtttctaaaa

SEQ ID NO: 136688 - DNA, 7235 bp, Homo sapiens
  Payload ID: 6763
  Gene Symbol: GATAD2B
  Gene Name: GATA zinc finger domain containing 2B
  Uniprot ID: Q8WXI9
  ENST ID: ENST00000576342
  CDS Start-End: 2-1783
gatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaaagggtttctggggaaggggagggggtagggaggcagggctgtggagggtgggtaggggagtgggccgggcccagcacactgagactggcagctgctccaaccccatccctccttagagatgccacctcccccaccacccacccctaatttgtgccttgcctccccaccctggagtagtccctccgggtcaccagcactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaagaaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttctgcattgtgtttgggaaataaaatgaaaaaactaagaccaatagaaactggttttcaaaaaggcaaatacactcccatctgtttcagatgctgctgagcatttcagcagtgacagattcaaataataagctaatttttggagaaaggattaaaagaaaaaaaaactttgtaatatttatcacttgcaagctatgtttaataaagaaaggaatggtttctaaaa

SEQ ID NO: 136689 - DNA, 2342 bp, Homo sapiens
  Payload ID: 6763
  Gene Symbol: GATAD2B
  Gene Name: GATA zinc finger domain containing 2B
  ENST ID: ENST00000634544
  CDS Start-End: 194-1975
tgggacacactggatctgtcttccagttcagttcctgagggtcggtggaacttacccttccctaaccacaccgggacttagagtacttttggcctccctgctctcaattacattgaggagcgagccactcatgcgagtgcagaggttcaggtgccattcgcgcgcccggtacagctttcccgtttcataaaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgat

SEQ ID NO: 136690 - DNA, 788 bp, Homo sapiens
  Payload ID: 6763
  Gene Symbol: GATAD2B
  Gene Name: GATA zinc finger domain containing 2B
  ENST ID: ENST00000634564
  CDS Start-End: 1-788
ccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctc

SEQ ID NO: 136691 - DNA, 867 bp, Homo sapiens
  Payload ID: 6763
  Gene Symbol: GATAD2B
  Gene Name: GATA zinc finger domain containing 2B
  ENST ID: ENST00000634401
  CDS Start-End: 305-867
ttgtttgtgtggtgccgccgccgccggtgcagccgtcgccgccgccgctgcccccgtctgtaccgcagtgtctgctccgcccgcccgccccggtccggcccgcccccctcccctacccccgtccctagtcccgtcagcagggtctggatcccctgtgccgtcgcctcttcctttttcgacgcctccgccgccgcctgaggaggcgagctagccgggagttacaccgccaccgccaggcaggtcttgaactcctggcctcaagtagtcctcctgccttggcctcctaaggtgttgggattacaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagaca

SEQ ID NO: 136692 - DNA, 642 bp, Homo sapiens
  Payload ID: 6763
  Gene Symbol: GATAD2B
  Gene Name: GATA zinc finger domain containing 2B
  ENST ID: ENST00000634791
  CDS Start-End: 196-642
ggtctggatcccctgtgccgtcgcctcttcctttttcgacgcctccgccgccgcctgaggaggcgagctagccgggagttacaccgccaccgccaggaaaactatttttcagcgtttgtaatggttctaatactgatctgattgctgagtccaaggatatacagtcatgcctcacgtaatggtagtcccataaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagcc

SEQ ID NO: 136693 - DNA, 1825 bp, Homo sapiens
  Payload ID: 6763
  Gene Symbol: GATAD2B
  Gene Name: GATA zinc finger domain containing 2B
  ENST ID: ENST00000634408
  CDS Start-End: 12-1745
ccaccgccaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgca

SEQ ID NO: 136694 - DNA, 1257 bp, Homo sapiens
  Payload ID: 6764
  Gene Symbol: GATSL2
  Gene Name: GATS protein-like 2
  Uniprot ID: A6NHX0
  ENST ID: ENST00000616305
  CDS Start-End: 169-1158
gcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccaggtgcaagttcttcagtctgactgagacgccagaggattacactatcattgtcgatgaggaaggattcctagagctgccctcctcggagcacctgagtgtggcagatgccacctggctggccctgaacgtggtgtccggcggtggcagcttctccagctcccagcccatcggcgtgaccaagatcgccaagtcagtcatcgccccactggctgaccagaacatatccgtgttcatgctgtccacgtatcagacagacttcatcctggtgcgcgagcgggacctgccctttgtcacccacacattgtcatcagagttcaccatcctgcgggtcgtcaatggcgagaccgtggcagccgagaacctcggcatcaccaatggcttcgtgaagcccaagctggtccagaggccagtcatccacccactgtccagcccgagcaacaggttctgtgtcaccagcctggaccctgacacgctgcctgctgttgccacactcctcatggatgtcatgttctactccaatggagtgaaggaccccatggccactggggatgactgcggccacatccgcttcttctccttctccctcatcgagggctacatctccctggtgatggacgtgcagacgcagcagaggtttcctagtaacttgctgttcacaagcgcatccggagagctctggaagatggtccggattggaggacagcccctggggtttgatgagtgtggcatcgtggcccagatctcagagcccttggctgctgcagacatcccagcctactacatcagtactttcaagtttgatcatgcacttgtccccgaagagaacatcaatggtgtcatcagtgccctgaaggtcagccaagcagagaagcactagaagggtctcttctgctcctccctgccgccgcccgggcccagccctaaccctgaagattgatcttgcagtatttctctacagactggaaaatcagcctgg

SEQ ID NO: 136695 - DNA, 1623 bp, Homo sapiens
  Payload ID: 6765
  Gene Symbol: GATSL3
  Gene Name: GATS protein-like 3
  Uniprot ID: Q8WTX7
  ENST ID: ENST00000407689
  CDS Start-End: 131-1120
agcctcgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttgccttccctggccaggtgagtcctgacagtgcctctccctcctggggcctccaaggaaagtattttgacatctctctctcttctgtttttattgacttgttaataaaggactttgtagtgac

SEQ ID NO: 136696 - DNA, 1460 bp, Homo sapiens
  Payload ID: 6765
  Gene Symbol: GATSL3
  Gene Name: GATS protein-like 3
  ENST ID: ENST00000404953
  CDS Start-End: 111-986
ggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttgccttccctggccaggtgagtcctgacagtgcctctccctcctggggcctccaaggaaagtattttgacatctctctctcttctgtttttatt

SEQ ID NO: 136697 - DNA, 975 bp, Homo sapiens
  Payload ID: 6765
  Gene Symbol: GATSL3
  Gene Name: GATS protein-like 3
  ENST ID: ENST00000421236
  CDS Start-End: 126-254
cgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctg

SEQ ID NO: 136698 - DNA, 580 bp, Homo sapiens
  Payload ID: 6765
  Gene Symbol: GATSL3
  Gene Name: GATS protein-like 3
  ENST ID: ENST00000440704
  CDS Start-End: 1-188
tggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaaggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttcccc

SEQ ID NO: 136699 - DNA, 794 bp, Homo sapiens
  Payload ID: 6765
  Gene Symbol: GATSL3
  Gene Name: GATS protein-like 3
  ENST ID: ENST00000425691
  CDS Start-End: 44-232
cctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaaggcaggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcc

SEQ ID NO: 136700 - DNA, 793 bp, Homo sapiens
  Payload ID: 6765
  Gene Symbol: GATSL3
  Gene Name: GATS protein-like 3
  ENST ID: ENST00000440839
  CDS Start-End: 73-201
ccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgc

SEQ ID NO: 136701 - DNA, 740 bp, Homo sapiens
  Payload ID: 6765
  Gene Symbol: GATSL3
  Gene Name: GATS protein-like 3
  ENST ID: ENST00000415484
  CDS Start-End: 9-233
gagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagatgaggaaactgagactcaaatcacccaccccaggtcataagacaaattaacaaagctgggatttgaacccagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcc

SEQ ID NO: 136702 - DNA, 2726 bp, Homo sapiens
  Payload ID: 6766
  Gene Symbol: GATS
  Gene Name: GATS, stromal antigen 3 opposite strand
  Uniprot ID: Q8NAP1
  ENST ID: ENST00000436886
  CDS Start-End: 236-727
tacagcgaacaccagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggggccttggtgtaccttgttgtagtgtttgaaaacatctgaggctgcatccatctccagcaccccataaagcaacagcttgcagaacccggctaggaggcggcgccgctggtgtagccgctctatctgtaaatgatcctcctgggaatcacctggctcacatggaaggcaaaagggaatcacagacttaagcttcctgccctatatttctgagctacacccaagccccagcccttactgagccccaggtatagagtcactgcaccactgcccaggtctcccggctggatgaagacgtggtccatgaggaagctggctagctcagactggagagtagcttcaggaaaaaagacaagtggcctaaggaaatcacggcccccaacaatcatctgagggctaaagatgagaagtagatcacttaataagacaaaagcctgtagggggaaaagaaaggatgtttaaaaggacagaatgtttcccaaggtagaaatgacactgtcaatttctccttggaatgggggcagggatactcgccttgttgctcccacttgagtcagtactcacctgctcctggatctcagtatccacatctgagaggcaactctggcagagttcacagaaggccaccattctgtccctcaaactcgacagctgcttctgtgggcacagtggcttgaaggggaagaatgaagacacagactcctctgttcccattatcccatctaagacccacactcacctgggaagcatctgatttagaaatgtgggttagtgtccagagaatggaaaaatagacaagagtcaaggctggcaggataacctgtaacaacaaagggtttgaaaaatgaggtttgggttaggagagggagagacagatagccagaaacacaccagtgaagaggagagaaaatgagtaaagggagagctaattccttttccagtggaaaatgagtgatattctggacattcttcagaggcatctacacgaagtagaaatgtcaccgctccctaatttactctacgtcttctagaatccctcaatattatccttggcttccaggaaatccaagaagaccctggaagtagagtccaccttctaagagaggaatgtaagaggtgacccccacccacctgatcttcctcgctttgtccactccacgcactgagacttgacacacctagtggccacctagaacgtaggtccttaaaatctagccccccagcccccaacccatctctagcctgtccactcacctggtgaggaacctctcctgtgtccacagccttctgcaggagttggcaacatggctcatagagctcccagcgagtcaggtcatgagtgctttgggggagaaaggggaatgttatactggaaaagaacagagggaaccaactccacagacaccagtaaaaacgggatggggaagaggaggaaagccactcacttgtagaaggcagagaggcgtttcagagtggctgccagattatatacctcatcctcatctaggaaggacgactgagaaggaaagaagatccacaatagcatttcccccagaactcatcagtccacatcccccgtcttgcagcccctcccacccttgtttggggtgtcccattgtccagccccagctcctacctgtaacagctcttcaagctcctgctggaagcggtcagtcagcaaatctactagctggctgcgggcaaagtccgcccggctgaagaaagtgaattcgggattacagagcaggtagagggcatgcgccccagcctcaagcaccgctggctctgcatgcttcaccaccacctcctggagttgctgcaggaacagctccaggtgctgagaagaaaaggcagaagatggtgtgctgtggggatgggaggaggacactcttctggcgggaagtggaacggggttaaaagcattaaacttcaaggataagatgcctaagaaaa

SEQ ID NO: 136703 - DNA, 1030 bp, Homo sapiens
  Payload ID: 6766
  Gene Symbol: GATS
  Gene Name: GATS, stromal antigen 3 opposite strand
  ENST ID: ENST00000454084
  CDS Start-End: 205-762
cacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctgtccagatgccggtcatccacccactgtccagcccgagcaacaggttctgtgtcaccagcctggaccccgacacgctgcctgctgttgccacactcctcatggatgtcatgtcctacttcaatggggccttggtgtaccttgttgtagtgtttgaaaacatctgaggctgcatccatctccagcaccccataaagcaacagcttgcagaacccggctaggaggcggcgccgctggtgtagccgctctatctgtaaatgatcctcctgggaatcacctggctcacatggaaggcaaaagggaatcacagacttaagcttcctgccctatatttctgagctacacccaagccccagcccttactgagccccaggtatagagtcactgcaccactgcccaggtctcccggctggatgaa

SEQ ID NO: 136704 - DNA, 1306 bp, Homo sapiens
  Payload ID: 6766
  Gene Symbol: GATS
  Gene Name: GATS, stromal antigen 3 opposite strand
  Uniprot ID: Q8NAP1
  ENST ID: ENST00000435519
  CDS Start-End: 232-723
gcgaacaccagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggtccagatgccggtcatccacccactgtccagcccgagcaacaggttctgtgtcaccagcctggaccccgacacgctgcctgctgttgccacactcctcatggatgtcatgtcctacttcaatggattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacaggaagtgctctgtggctaaaacaagtccaaaaagcacccacagagaggcaatgggtgagacaggaatcccctcacagtggg

SEQ ID NO: 136705 - DNA, 2007 bp, Homo sapiens
  Payload ID: 6766
  Gene Symbol: GATS
  Gene Name: GATS, stromal antigen 3 opposite strand
  Uniprot ID: Q8NAP1
  ENST ID: ENST00000414739
  CDS Start-End: 232-723
gcgaacaccagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggtccagatgccggtcatccacccactgtccagcccgagcaacaggttctgtgtcaccagcctggaccccgacacgctgcctgctgttgccacactcctcatggatgtcatgtcctacttcaatgggtgaggatacaactagaagccagcagtctacaggctggaagaaggccctcaccagaacccaacccttggacttcagcctccagaactgtgagaaatacatacctgctgtttgtaagacaccagtctatggaattctgttacagtagcctgaactcagacatagcccttttccatttataaggtggttttaccttatattttatgtaaaaggtccattttatttatttttgaattgttgatttttttttaagagacacgtgtttactatgttacccaggctggactccaactcctggactattgatcctcctgtctccacctcccgagttgctggaactacaggctaacagctctgttttaaagatgagaaaatgggccccacgcagtggctcacacctgtaatcccagcacttagggaggctgagccaggtggagccacttgaggtcaggtgttcgagattagcctggccaacatggcaaaaccccgtctctactaaaaatacaaaaaaaattagccgggcatgatggcgcgtgcctgtaatcccagctacttgggagtctgaggcaggagaattgcttgagcccaggaggcagaggttgcagtgagccgagactatgccactgcactccagcctaggtgacaaagagagactctacctcaaaaaataaaaataattaaaaaataaagatgagaaaatggaggctgaggaggggtaaaagcgctaacttgacatggagttgaggactagcactcatgtcacctcactccaaatgccaggcttttcccactacaccagcagcagttcctcctggggaaacaggctaggttagaaagggagtgagggaagggacagggaggggaagccctctagtagggagatggaggatagggggtcatgttttgtggggagagacactgaaggggctgccacttggactgaatgacctcccacctccagcattaggactccttccaattcctagggggttcggaggcaacaatatttatttagggattgggagcgagagtgctattccaaccttctttggtatttgtaatttcttttccttattctttaataaaagtagagtccaagcaaagtccaaaccaa

SEQ ID NO: 136706 - DNA, 2840 bp, Homo sapiens
  Payload ID: 6766
  Gene Symbol: GATS
  Gene Name: GATS, stromal antigen 3 opposite strand
  Uniprot ID: Q8NAP1
  ENST ID: ENST00000543273
  CDS Start-End: 226-717
accagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggtccagatgccggtcatccacccactgtccagcccgagcaacaggttctgtgtcaccagcctggaccccgacacgctgcctgctgttgccacactcctcatggatgtcatgtcctacttcaatggggccttggtgtaccttgttgtagtgtttgaaaacatctgaggctgcatccatctccagcaccccataaagcaacagcttgcagaacccggctaggaggcggcgccgctggtgtagccgctctatctgtaaatgatcctcctgggaatcacctggctcacatggaaggcaaaagggaatcacagacttaagcttcctgccctatatttctgagctacacccaagccccagcccttactgagccccaggtatagagtcactgcaccactgcccaggtctcccggctggatgaagacgtggtccatgaggaagctggctagctcagactggagagtagcttcaggaaaaaagacaagtggcctaaggaaatcacggcccccaacaatcatctgagggctaaagatgagaagtagatcacttaataagacaaaagcctgtagggggaaaagaaaggatgtttaaaaggacagaatgtttcccaaggtagaaatgacactgtcaatttctccttggaatgggggcagggatactcgccttgttgctcccacttgagtcagtactcacctgctcctggatctcagtatccacatctgagaggcaactctggcagagttcacagaaggccaccattctgtccctcaaactcgacagctgcttctgtgggcacagtggcttgaaggggaagaatgaagacacagactcctctgttcccattatcccatctaagacccacactcacctgggaagcatctgatttagaaatgtgggttagtgtccagagaatggaaaaatagacaagagtcaaggctggcaggataacctgtaacaacaaagggtttgaaaaatgaggtttgggttaggagagggagagacagatagccagaaacacaccagtgaagaggagagaaaatgagtaaagggagagctaattccttttccagtggaaaatgagtgatattctggacattcttcagaggcatctacacgaagtagaaatgtcaccgctccctaatttactctacgtcttctagaatccctcaatattatccttggcttccaggaaatccaagaagaccctggaagtagagtccaccttctaagagaggaatgtaagaggtgacccccacccacctgatcttcctcgctttgtccactccacgcactgagacttgacacacctagtggccacctagaacgtaggtccttaaaatctagccccccagcccccaacccatctctagcctgtccactcacctggtgaggaacctctcctgtgtccacagccttctgcaggagttggcaacatggctcatagagctcccagcgagtcaggtcatgagtgctttgggggagaaaggggaatgttatactggaaaagaacagagggaaccaactccacagacaccagtaaaaacgggatggggaagaggaggaaagccactcacttgtagaaggcagagaggcgtttcagagtggctgccagattatatacctcatcctcatctaggaaggacgactgagaaggaaagaagatccacaatagcatttcccccagaactcatcagtccacatcccccgtcttgcagcccctcccacccttgtttggggtgtcccattgtccagccccagctcctacctgtaacagctcttcaagctcctgctggaagcggtcagtcagcaaatctactagctggctgcgggcaaagtccgcccggctgaagaaagtgaattcgggattacagagcaggtagagggcatgcgccccagcctcaagcaccgctggctctgcatgcttcaccaccacctcctggagttgctgcaggaacagctccaggtgctgagaagaaaaggcagaagatggtgtgctgtggggatgggaggaggacactcttctggcgggaagtggaacggggttaaaagcattaaacttcaaggataagatgcctaagaaaa

SEQ ID NO: 136707 - DNA, 3526 bp, Homo sapiens
  Payload ID: 6766
  Gene Symbol: GATS
  Gene Name: GATS, stromal antigen 3 opposite strand
  Uniprot ID: Q8NAP1
  ENST ID: ENST00000328453
  CDS Start-End: 224-715
cagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggtccagatgccggtcatccacccactgtccagcccgagcaacaggttctgtgtcaccagcctggaccccgacacgctgcctgctgttgccacactcctcatggatgtcatgtcctacttcaatgggtgaggatacaactagaagccagcagtctacaggctggaagaaggccctcaccagaacccaacccttggacttcagcctccagaactattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacaggaagtgctctgtggctaaaacaagtccaaaaagcacccacagagaggcaatgggtgagacaggaatcccctcacagtgggcgacagatctgaagtgaagacaggagatgatgagaaaagctcaccgcatcagctggttgcccaggccaggacctgaagggttgtgtggagtctggaaatattgtggacccaagaaccttgacctctcggtgcctgcgacgggctgactgctgggaatgaagcaggatcaatgatgggataaaaatcaaggggccttggtgtaccttgttgtagtgtttgaaaacatctgaggctgcatccatctccagcaccccataaagcaacagcttgcagaacccggctaggaggcggcgccgctggtgtagccgctctatctgtaaatgatcctcctgggaatcacctggctcacatggaaggcaaaagggaatcacagacttaagcttcctgccctatatttctgagctacacccaagccccagcccttactgagccccaggtatagagtcactgcaccactgcccaggtctcccggctggatgaagacgtggtccatgaggaagctggctagctcagactggagagtagcttcaggaaaaaagacaagtggcctaaggaaatcacggcccccaacaatcatctgagggctaaagatgagaagtagatcacttaataagacaaaagcctgtagggggaaaagaaaggatgtttaaaaggacagaatgtttcccaaggtagaaatgacactgtcaatttctccttggaatgggggcagggatactcgccttgttgctcccacttgagtcagtactcacctgctcctggatctcagtatccacatctgagaggcaactctggcagagttcacagaaggccaccattctgtccctcaaactcgacagctgcttctgtgggcacagtggcttgaaggggaagaatgaagacacagactcctctgttcccattatcccatctaagacccacactcacctgggaagcatctgatttagaaatgtgggttagtgtccagagaatggaaaaatagacaagagtcaaggctggcaggataacctgtaacaacaaagggtttgaaaaatgaggtttgggttaggagagggagagacagatagccagaaacacaccagtgaagaggagagaaaatgagtaaagggagagctaattccttttccagtggaaaatgagtgatattctggacattcttcagaggcatctacacgaagtagaaatgtcaccgctccctaatttactctacgtcttctagaatccctcaatattatccttggcttccaggaaatccaagaagaccctggaagtagagtccaccttctaagagaggaatgtaagaggtgacccccacccacctgatcttcctcgctttgtccactccacgcactgagacttgacacacctagtggccacctagaacgtaggtccttaaaatctagccccccagcccccaacccatctctagcctgtccactcacctggtgaggaacctctcctgtgtccacagccttctgcaggagttggcaacatggctcatagagctcccagcgagtcaggtcatgagtgctttgggggagaaaggggaatgttatactggaaaagaacagagggaaccaactccacagacaccagtaaaaacgggatggggaagaggaggaaagccactcacttgtagaaggcagagaggcgtttcagagtggctgccagattatatacctcatcctcatctaggaaggacgactgagaaggaaagaagatccacaatagcatttcccccagaactcatcagtccacatcccccgtcttgcagcccctcccacccttgtttggggtgtcccattgtccagccccagctcctacctgtaacagctcttcaagctcctgctggaagcggtcagtcagcaaatctactagctggctgcgggcaaagtccgcccggctgaagaaagtgaattcgggattacagagcaggtagagggcatgcgccccagcctcaagcaccgctggctctgcatgcttcaccaccacctcctggagttgctgcaggaacagctccaggtgctgagaagaaaaggcagaagatggtgtgctgtggggatgggaggaggacactcttctggcgggaagtggaacggggttaaaagcattaaacttcaaggataagatgcctaagaaaa

SEQ ID NO: 136708 - DNA, 8675 bp, Homo sapiens
  Payload ID: 6767
  Gene Symbol: GCN1
  Gene Name: GCN1 eIF2 alpha kinase activator homolog
  Uniprot ID: Q92616
  ENST ID: ENST00000300648
  CDS Start-End: 14-8029
cagccccggcaggatggcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgacccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaataaggaa

SEQ ID NO: 136709 - DNA, 1786 bp, Homo sapiens
  Payload ID: 6768
  Gene Symbol: GPBP1
  Gene Name: GC-rich promoter binding protein 1
  Uniprot ID: Q86WP2
  ENST ID: ENST00000264779
  CDS Start-End: 11-1453
ctggacctaaatggcgcagcatgactttgctccagcctggcttaatttccctactccaccatcatcaacaaaggtcctgaccagcagtttgaaatcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaa

SEQ ID NO: 136710 - DNA, 4683 bp, Homo sapiens
  Payload ID: 6768
  Gene Symbol: GPBP1
  Gene Name: GC-rich promoter binding protein 1
  ENST ID: ENST00000424459
  CDS Start-End: 1275-2756
cacactctttctccctccttctcctcgccccgccttccctccctcctcaatccctctagttccttccccgcctcgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaagtgtttgttgttttttaaaaagtgttttctcagatggctgcagtgtttttgctatttctgcataaataccctacctggactccccagttttcaccagaaactgttatttttttttgttgttgttcccactgagactgatggtgatggggaaattaaaaacaacacactagcacactcccacaaaacttgaggaagagttagaatggtaataaaatattaaatagaccttatacttaaaataaggtttcactatataatttgtcacaattcaatctaatcagctaaagttaaatgtagttagaattagccacaggagaatgtaaagcatgctttgacgaagctatcggtaacacatattgaatgtctttgagactcttagattgtactatttgcttaatagattaatgaaatttatcagatacaacctgtatttccaaaaacaagctagaaggaacctgaggaatgtggtttacatttgagatccaccttactgtgttttctactttcagaaaagattctgtagttttggtttttggcatctttcttatactcagttttttctgccttaattcccatttaccagcagttaactcatgtttattgtgctttcatgcattgtgatatggaatgtgtttagtaatttactccttataaatatggtaaagtacagtggta

SEQ ID NO: 136711 - DNA, 2857 bp, Homo sapiens
  Payload ID: 6768
  Gene Symbol: GPBP1
  Gene Name: GC-rich promoter binding protein 1
  Uniprot ID: Q86WP2
  ENST ID: ENST00000506184
  CDS Start-End: 1106-2527
cggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgc

SEQ ID NO: 136712 - DNA, 3310 bp, Homo sapiens
  Payload ID: 6768
  Gene Symbol: GPBP1
  Gene Name: GC-rich promoter binding protein 1
  Uniprot ID: Q86WP2
  ENST ID: ENST00000514387
  CDS Start-End: 1567-2475
ggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaattttcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaata

SEQ ID NO: 136713 - DNA, 2243 bp, Homo sapiens
  Payload ID: 6768
  Gene Symbol: GPBP1
  Gene Name: GC-rich promoter binding protein 1
  Uniprot ID: Q86WP2
  ENST ID: ENST00000511209
  CDS Start-End: 513-1910
tttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaaggtcctgaccagcagtttgaaatcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaa

SEQ ID NO: 136714 - DNA, 3599 bp, Homo sapiens
  Payload ID: 6769
  Gene Symbol: GPBP1L1
  Gene Name: GC-rich promoter binding protein 1-like 1
  Uniprot ID: Q9HC44
  ENST ID: ENST00000290795
  CDS Start-End: 1223-2647
cgggcagccattttgggaagagctttgttatggttgtggactagccgcctctgccgggtcgacaagctggggacgcgtcctcagacgcagcgtctagtccctggccatagctccgccgctgcccgagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaaccaa

SEQ ID NO: 136715 - DNA, 3736 bp, Homo sapiens
  Payload ID: 6769
  Gene Symbol: GPBP1L1
  Gene Name: GC-rich promoter binding protein 1-like 1
  Uniprot ID: Q9HC44
  ENST ID: ENST00000355105
  CDS Start-End: 1362-2786
gtgtgtaaggcggggtcggacgggggatgggagggccgtgctgctggtcgctcctcctcctccacccgctctgcccctcctggaccttgtgggccgggcagccattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaacc

SEQ ID NO: 136716 - DNA, 4440 bp, Homo sapiens
  Payload ID: 6770
  Gene Symbol: GCFC2
  Gene Name: GC-rich sequence DNA-binding factor 2
  Uniprot ID: P16383
  ENST ID: ENST00000321027
  CDS Start-End: 135-2480
gagcagaaggcaggcgggacgggcgcgcgcactcggcggccaggcgcggcgggagcgcgccctagggggcgggcactgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcaatggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatatcttttagttctctttaactacctttatttaaaaataagtcaatatgaaaatctcagttggagtgaattatttgctaagtattaaatgattaaggcatgtgccgattgtcaaattatccttcagaaatctgtaccaatttaatgtaccaacataagcataagtgagtgccaatgaatccctaccagcagtagttattatcctttttaaaaatgcattgaaaatttgaaaggtaaaaatcttattttaatagcgtattttgtgttggctattagagagtaaacatattggttttggccatttgtaattatttctgaaatatccatctttttcttatggactttaagacctttatatttttaaagatattgattttttgcccatgcttgtggcagaagttttccttatttgccatttttcttttattttttttttaattgtattttttgagacagggtctggctctgtcacccaggctggagagtagtggcacaatctcggctcactgcaacctctgccttctgggctcaagcaatcctcccacttcaacctcccaagtagctgggactataggcatgcgccaccatgcccagctgatttttgtaattttttgtagagatggggtttcgtgacattgcccaggctggtctcgaactcttgagctcaagcagtctacccaccttgacctcccaaagtgctgggattacaggcttgagcaaccatgtttggcctttcttttaaatttgttgatgttttttgaagcattaagtcattacttattagcaagttactattttgtttttttgtcattggtggtaggactaagaaggaaacagatattttaaatactcacaacatgtgattcattttctgataaaatatttgtctaataaaacagaggcaagataatttaatcaaaagaaattaagaaaattttccaaaaatgttagtttactagtaatttttctaagtctacttattaaataacttaagggaaactgtaaatatattttgcaaattgttgttcaaaagataattggaaaaaattgaatatattgtaggatttgaatatacagcctacttttatgtcacctctaccttcaaaactacatataatttattttaggagttggatttgttatgtctgttgcagtgaggacttgtgattcactggtatgaagaattttttgatgtttatattagtaacaaaattatacaaggatagaatctcatctagaaaatgcaaactattgttgaaaagcagttagcatttccacacaaccgctgtccccagagataactgctgttttcattttaatgttatccttttagaccttttctctatttacaaaaatgttacgtgtttctatgtgtacatagttttgggttttttttttttttttacgtaagtggcagacactttattgcacatgaaatttgtaatttttttctatttaagtacacatttggaaattatcctctgacttttggatttttaactaaatatgttggacgtgttcctttatatatttaagttcagcacagaaactttcctacctttttgtggaagataaaatattaaaactgctttcaaaactacaa

SEQ ID NO: 136717 - DNA, 2516 bp, Homo sapiens
  Payload ID: 6770
  Gene Symbol: GCFC2
  Gene Name: GC-rich sequence DNA-binding factor 2
  Uniprot ID: P16383
  ENST ID: ENST00000409857
  CDS Start-End: 38-2269
agcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctgtaagcagaaatgaagaaacaagtgaagaaagtcaggaagatgaaaagcaagatacttgggaacaacagcaaatgaggaaagcagttaaaatcatagaggaaagagacatagatctttcctgtggcaatggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttg

SEQ ID NO: 136718 - DNA, 632 bp, Homo sapiens
  Payload ID: 6770
  Gene Symbol: GCFC2
  Gene Name: GC-rich sequence DNA-binding factor 2
  ENST ID: ENST00000427862
  CDS Start-End: 1-600
aaagtagttcagataaaaaagtcttgtctgcaatcatcaacaaaacaattattccccgacttacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaa

SEQ ID NO: 136719 - DNA, 642 bp, Homo sapiens
  Payload ID: 6770
  Gene Symbol: GCFC2
  Gene Name: GC-rich sequence DNA-binding factor 2
  ENST ID: ENST00000442309
  CDS Start-End: 87-642
gcgggagcgcgccctagggggcgggcactgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagtaagcagaaatgaagaaacaagtgaagaaagtcaggaagatgaaaagcaagatacttgggaacaacagcaaatgaggaaagcagttaaaatcatagaggaaagagacatagatctttcctgtggcaatggatcttcaaaagtgaagaaatttgatacttcca

SEQ ID NO: 136720 - DNA, 4318 bp, Homo sapiens
  Payload ID: 6770
  Gene Symbol: GCFC2
  Gene Name: GC-rich sequence DNA-binding factor 2
  Uniprot ID: P16383
  ENST ID: ENST00000541687
  CDS Start-End: 131-895
agaaggcaggcgggacgggcgcgcgcactcggcggccaggcgcggcgggagcgcgccctagggggcgggcactgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatatcttttagttctctttaactacctttatttaaaaataagtcaatatgaaaatctcagttggagtgaattatttgctaagtattaaatgattaaggcatgtgccgattgtcaaattatccttcagaaatctgtaccaatttaatgtaccaacataagcataagtgagtgccaatgaatccctaccagcagtagttattatcctttttaaaaatgcattgaaaatttgaaaggtaaaaatcttattttaatagcgtattttgtgttggctattagagagtaaacatattggttttggccatttgtaattatttctgaaatatccatctttttcttatggactttaagacctttatatttttaaagatattgattttttgcccatgcttgtggcagaagttttccttatttgccatttttcttttattttttttttaattgtattttttgagacagggtctggctctgtcacccaggctggagagtagtggcacaatctcggctcactgcaacctctgccttctgggctcaagcaatcctcccacttcaacctcccaagtagctgggactataggcatgcgccaccatgcccagctgatttttgtaattttttgtagagatggggtttcgtgacattgcccaggctggtctcgaactcttgagctcaagcagtctacccaccttgacctcccaaagtgctgggattacaggcttgagcaaccatgtttggcctttcttttaaatttgttgatgttttttgaagcattaagtcattacttattagcaagttactattttgtttttttgtcattggtggtaggactaagaaggaaacagatattttaaatactcacaacatgtgattcattttctgataaaatatttgtctaataaaacagaggcaagataatttaatcaaaagaaattaagaaaattttccaaaaatgttagtttactagtaatttttctaagtctacttattaaataacttaagggaaactgtaaatatattttgcaaattgttgttcaaaagataattggaaaaaattgaatatattgtaggatttgaatatacagcctacttttatgtcacctctaccttcaaaactacatataatttattttaggagttggatttgttatgtctgttgcagtgaggacttgtgattcactggtatgaagaattttttgatgtttatattagtaacaaaattatacaaggatagaatctcatctagaaaatgcaaactattgttgaaaagcagttagcatttccacacaaccgctgtccccagagataactgctgttttcattttaatgttatccttttagaccttttctctatttacaaaaatgttacgtgtttctatgtgtacatagttttgggttttttttttttttttacgtaagtggcagacactttattgcacatgaaatttgtaatttttttctatttaagtacacatttggaaattatcctctgacttttggatttttaactaaatatgttggacgtgttcctttatatatttaagttcagcacagaaactttcctacctttttgtggaagataaaatattaaaactgctttcaaaactac

SEQ ID NO: 136721 - DNA, 2265 bp, Homo sapiens
  Payload ID: 6770
  Gene Symbol: GCFC2
  Gene Name: GC-rich sequence DNA-binding factor 2
  ENST ID: ENST00000472230
  CDS Start-End: 1-108
gcggacgaaggctcaggtgtccagggagacgcggggaagcggggaggtgacggcacagggcgggaaggggccgcggggtctctggatccttctctgggggttctataacttgctgccgaccacaagccatgctgagtcttatccagaaagacttatccagaagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcaatggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgc

SEQ ID NO: 136722 - DNA, 1066 bp, Homo sapiens
  Payload ID: 6770
  Gene Symbol: GCFC2
  Gene Name: GC-rich sequence DNA-binding factor 2
  Uniprot ID: P16383
  ENST ID: ENST00000470503
  CDS Start-End: 45-692
gcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaagtatggatttaccaatatatgaagattaggatattttttattagaatataatatgagagaatctccataaaaaatgtaatatgctggctcacattttatagtgttgataatggtttttaacatcgatttggtccatgatattgtgacctctaaaagatgtatctgtatcaaaatgttattatcaaggagtatgtgtaataatgtttattaatgcctgacctcccaccttgatgtttttggacaggttaaaaaaaatgtgcagtatcttactttcaaagcattgaaaacgatcgtttttacctgtataaatatattttttttaacatggaagcatctatagagattttagatgtcatgtattaaaatcttccctgctgtaataaaaaatttcctctaccaataa

SEQ ID NO: 136723 - DNA, 443 bp, Homo sapiens
  Payload ID: 6770
  Gene Symbol: GCFC2
  Gene Name: GC-rich sequence DNA-binding factor 2
  ENST ID: ENST00000492826
  CDS Start-End: 1-83
agctgctaaatcgttaccttattatagcacttctcaatgccacacctgggccagatgtggttaaaaagtgcaaccagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttga

SEQ ID NO: 136724 - DNA, 423 bp, Homo sapiens
  Payload ID: 6770
  Gene Symbol: GCFC2
  Gene Name: GC-rich sequence DNA-binding factor 2
  ENST ID: ENST00000470285
  CDS Start-End: 1-131
gaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaagaggatctgttcttccccttcgaggaatgaattcaggactcaagaacctgtaaaaaatacaaataaataattaaaagtaaactcaaaaggctgctagaagaaaaattgttgcttttcaaagaaattaaatatgatattgatgtattttattcttcattgtctaaataaaagtcaatcttatttctaaaa

SEQ ID NO: 136725 - DNA, 2583 bp, Homo sapiens
  Payload ID: 6771
  Gene Symbol: GFRA1
  Gene Name: GDNF family receptor alpha 1
  Uniprot ID: P56159
  ENST ID: ENST00000355422
  CDS Start-End: 552-1949
tctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctatttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaac

SEQ ID NO: 136726 - DNA, 1807 bp, Homo sapiens
  Payload ID: 6771
  Gene Symbol: GFRA1
  Gene Name: GDNF family receptor alpha 1
  Uniprot ID: P56159
  ENST ID: ENST00000369234
  CDS Start-End: 413-1807
ggcccggggggcgctcgtggcgccgggctgcacctgccggggcacgccgggactgcgggccggcgcgctcgccctgggctggggtgcggaagcgcccgagtcctgggcaccgggcgagagtgtgagaggagcggacgcccaggagggagccgaggacgcgcggcgggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatca

SEQ ID NO: 136727 - DNA, 9109 bp, Homo sapiens
  Payload ID: 6771
  Gene Symbol: GFRA1
  Gene Name: GDNF family receptor alpha 1
  Uniprot ID: P56159
  ENST ID: ENST00000369236
  CDS Start-End: 254-1636
cttccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaacgtcttggccactgtttggagcagtttggtctgaaggtcattaaggatctgcttgcatcttgtttcatgtcctccgtgacagactgcagaccatgttagaagagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaatatttggaatgccagttatctatgagcgcatatctcttacagagtgtattttgttttcattaaggtatctctgtgtatctacactggactaatttcatagggatctgattctatgtgatccactgtagaaagctactgattacttctgcagtaacagcagctctaattagcatcagatgaccaaagcggaaatgggagtttcagcgctaacaagggcagccttcattgaagaatgcatgggtaggcaatatataaattacattttgaaaagcctcatctgtcaccaacaaatatctcatttttcttcagtgataaaagcatattcaagttaccagctcctcaatttgaaaatcagttgctgattaaataaatagggggaagcatcttgttcagggacaacacgttagagagattcttatcaaagcaagccaagcaaggtttccgccattcagtgtgatcttagtttgacacggtgaccctaaaacaccatcatttgccccagaactggagcacaataagttaaatcatttacctgtctcacttcttcttggcgtgcttaaaagcaaaaatgattcgctacttcctgtccttcagtccgggcatttggggtgccactgaagacaggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaattttcttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttaaaaaaaa

SEQ ID NO: 136728 - DNA, 9216 bp, Homo sapiens
  Payload ID: 6771
  Gene Symbol: GFRA1
  Gene Name: GDNF family receptor alpha 1
  Uniprot ID: P56159
  ENST ID: ENST00000439649
  CDS Start-End: 369-1751
cgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaacgtcttggccactgtttggagcagtttggtctgaaggtcattaaggatctgcttgcatcttgtttcatgtcctccgtgacagactgcagaccatgttagaagagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaatatttggaatgccagttatctatgagcgcatatctcttacagagtgtattttgttttcattaaggtatctctgtgtatctacactggactaatttcatagggatctgattctatgtgatccactgtagaaagctactgattacttctgcagtaacagcagctctaattagcatcagatgaccaaagcggaaatgggagtttcagcgctaacaagggcagccttcattgaagaatgcatgggtaggcaatatataaattacattttgaaaagcctcatctgtcaccaacaaatatctcatttttcttcagtgataaaagcatattcaagttaccagctcctcaatttgaaaatcagttgctgattaaataaatagggggaagcatcttgttcagggacaacacgttagagagattcttatcaaagcaagccaagcaaggtttccgccattcagtgtgatcttagtttgacacggtgaccctaaaacaccatcatttgccccagaactggagcacaataagttaaatcatttacctgtctcacttcttcttggcgtgcttaaaagcaaaaatgattcgctacttcctgtccttcagtccgggcatttggggtgccactgaagacaggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaattttcttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttctttttt

SEQ ID NO: 136729 - DNA, 3558 bp, Homo sapiens
  Payload ID: 6772
  Gene Symbol: GFRA2
  Gene Name: GDNF family receptor alpha 2
  ENST ID: ENST00000306793
  CDS Start-End: 661-849
ggagagagaaagacacacgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctaggcccagggccgctgctgaggaggaatggagtgcaaagggagaaaacttgctcctacatccaggggaggatgatgcctgagttctccctggggtatgaggagggctgtcccacagagtcgccttggtgtgctttggcgaaatgggtgtgacgttcccagcagggcccaagcccccaggcctgcatcttgggtgggagattgtggcggccgtcattcatgcttgtcttccctccccaccacccagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagcaa

SEQ ID NO: 136730 - DNA, 4921 bp, Homo sapiens
  Payload ID: 6772
  Gene Symbol: GFRA2
  Gene Name: GDNF family receptor alpha 2
  Uniprot ID: O00451
  ENST ID: ENST00000524240
  CDS Start-End: 652-2046
aagacacacgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagcaagctgcctctgcctcggtcccgtggggttttgcccccattttgttcttggtccagtgttacctgcgtaagtggagctcccagtgggctggggaaatgtgtgtccgtgtgtgtgcctgtgtgcatgtgtgtgcatccatgtgtctcacccatgtgtccacattgtgtgtagatggagctctcttaggagctggtttgacactgggggcgggatctgagggtccacgctgtgctgagcctggtgggctgttctgttccctctttgctcacttctccagttggcgcaaatgcctgtggctcccaggctggaagagaatgcagtggacgtggacgtggtggggagccacagcttggcatcacacgttgggaatgttttattgtcaggctgtctgggtggccctgttagtcttacatagagcaaagtggtatgtccctctgggactcctggcttatttgagatgtgtgattgtgagtgcagtgacctggccttttgggtcccaccagagaagaaggacatgactgtgcatgttctggggtcatggtctgaaagcataagtattttttgggtctccctctattccttcctttcctgtttctccatttgctacccaggccccacttggacactaggcctgccatagtctccaagagagattctccccagagaggaccaggagaatgcctgctggccaagtgtgtgtgtgtccatgtatgtgagcatgtgtacatgtgtgtgcggtcgtgtgcaggctcgcacatgttcacgtgcacgtgtgaatatatacccatggcaggagggagaatggaagactggtaggcgagaagatgtttctactgtcagcctggccttcagggctgcatgtgagcccatcccatttcaactggacaataggatgcagttttcccatctcccaatcgcaggtcccctcaatggcttttgcttctggttgtatatgtgtgagcagcatccgttcacagcgtttatcactgtggtgtattgccttccagcctctgcatggaaggggtacagtgagccagccaggtctctgtccagccattgcgggtagacgtggtcatggcatccacttaggaatccgtgttctttgcaaacagcaaagaccatttaacttaaaaagtactttactggaaggctatgggagaaggtggctcacggaatttgtgggaggtggggggaccaggggaggcgagggcagggactggagggcatctgaggggctggaaggcaggatgtacagggtcagcattctgctgccaaccattgcccatctggctgaactgggccttgtgcctgccctctgccatacttgagtgtgagagagaggatatatatgtcatgtctggtatccctaataggaggtaagcccttaggctacatcatgggggagagaaaatttcccaagaggaaactgaggtgccattatgaaggaggagtggatactagctagctttactctgccctcaaatgtctccctatccaagtatcacatggctgaaattttaccattaggtattcattcctttggttgagatgattcctatttgtgattctctcaaaatatgcaaatcgaactagaagaataaattgttgctatcttaa

SEQ ID NO: 136731 - DNA, 872 bp, Homo sapiens
  Payload ID: 6772
  Gene Symbol: GFRA2
  Gene Name: GDNF family receptor alpha 2
  ENST ID: ENST00000522071
  CDS Start-End: 79-872
gccgtagccgggggagccagtcagtttccggccaaggcagcagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcg

SEQ ID NO: 136732 - DNA, 1503 bp, Homo sapiens
  Payload ID: 6772
  Gene Symbol: GFRA2
  Gene Name: GDNF family receptor alpha 2
  Uniprot ID: O00451
  ENST ID: ENST00000518077
  CDS Start-End: 165-1160
gagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcgg

SEQ ID NO: 136733 - DNA, 2104 bp, Homo sapiens
  Payload ID: 6772
  Gene Symbol: GFRA2
  Gene Name: GDNF family receptor alpha 2
  Uniprot ID: O00451
  ENST ID: ENST00000517328
  CDS Start-End: 275-1669
gggagtggagccagcagctgagaccccggcaagggcaaccatggatctggagttggaacgggacaatgcgccatcaggccggcagaagctggcagatgagggccgagttgcggcacacaggtgccagatctccaaatagaggaaattggaaagaaaaagataaagctaatctgtaatttcatcacccggagacaactgctgttgacattgcattgtgtgtctaaggaggactttgacagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctg

SEQ ID NO: 136734 - DNA, 1176 bp, Homo sapiens
  Payload ID: 6772
  Gene Symbol: GFRA2
  Gene Name: GDNF family receptor alpha 2
  Uniprot ID: O00451
  ENST ID: ENST00000517892
  CDS Start-End: 1-1080
atgatcttggcaaacgtcttctgcctcttcttctttctaggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgc

SEQ ID NO: 136735 - DNA, 546 bp, Homo sapiens
  Payload ID: 6772
  Gene Symbol: GFRA2
  Gene Name: GDNF family receptor alpha 2
  ENST ID: ENST00000519195
  CDS Start-End: 325-546
gtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttc

SEQ ID NO: 136736 - DNA, 2039 bp, Homo sapiens
  Payload ID: 6773
  Gene Symbol: GFRA3
  Gene Name: GDNF family receptor alpha 3
  Uniprot ID: O60609
  ENST ID: ENST00000274721
  CDS Start-End: 248-1450
gcggctcccggggcgccggccctcccccgcccccacccccgcggtccctcggaccagcgctggaggcgcgtggtgtggacgcgcgcttcggagttggagggcggcgcccaggaccctggtgggagagtgtgtgcgtcgcgctggagggcgggaggcgggggcgggaggtgccggtcgagggagccccgctctcagagctccaggggaggagcgaggggagcgcggagcccggcgcctacagctcgccatggtgcgccccctgaacccgcgaccgctgccgcccgtagtcctgatgttgctgctgctgctgccgccgtcgccgctgcctctcgcagccggagacccccttcccacagaaagccgactcatgaacagctgtctccaggccaggaggaagtgccaggctgatcccacctgcagtgctgcctaccaccacctggattcctgcacctctagcataagcaccccactgccctcagaggagccttcggtccctgctgactgcctggaggcagcacagcaactcaggaacagctctctgataggctgcatgtgccaccggcgcatgaagaaccaggttgcctgcttggacatctattggaccgttcaccgtgcccgcagccttggtaactatgagctggatgtctccccctatgaagacacagtgaccagcaaaccctggaaaatgaatctcagcaaactgaacatgctcaaaccagactcagacctctgcctcaagtttgccatgctgtgtactctcaatgacaagtgtgaccggctgcgcaaggcctacggggaggcgtgctccgggccccactgccagcgccacgtctgcctcaggcagctgctcactttcttcgagaaggccgccgagccccacgcgcagggcctgctactgtgcccatgtgcccccaacgaccggggctgcggggagcgccggcgcaacaccatcgcccccaactgcgcgctgccgcctgtggcccccaactgcctggagctgcggcgcctctgcttctccgacccgctttgcagatcacgcctggtggatttccagacccactgccatcccatggacatcctaggaacttgtgcaacagagcagtccagatgtctacgagcatacctggggctgattgggactgccatgacccccaactttgtcagcaatgtcaacaccagtgttgccttaagctgcacctgccgaggcagtggcaacctgcaggaggagtgtgaaatgctggaagggttcttctcccacaacccctgcctcacggaggccattgcagctaagatgcgttttcacagccaactcttctcccaggactggccacaccctacctttgctgtgatggcacaccagaatgaaaaccctgctgtgaggccacagccctgggtgccctctcttttctcctgcacgcttcccttgattctgctcctgagcctatggtagctggacttccccagggccctcttcccctccaccacacccaggtggacttgcagcccacaaggggtgaggaaaggacagcagcaggaaggaggtgcagtgcgcagatgagggcacaggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagccattctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgacttaag

SEQ ID NO: 136737 - DNA, 1837 bp, Homo sapiens
  Payload ID: 6773
  Gene Symbol: GFRA3
  Gene Name: GDNF family receptor alpha 3
  Uniprot ID: O60609
  ENST ID: ENST00000378362
  CDS Start-End: 142-1251
cccaggaccctggtgggagagtgtgtgcgtcgcgctggagggcgggaggcgggggcgggaggtgccggtcgagggagccccgctctcagagctccaggggaggagcgaggggagcgcggagcccggcgcctacagctcgccatggtgcgccccctgaacccgcgaccgctgccgcccgtagtcctgatgttgctgctgctgctgccgccgtcgccgctgcctctcgcagccggagacccccttcccacagaaagccgactcatgaacagctgtctccaggccaggaggaagtgccaggctgatcccacctgcagtgctgcctaccaccacctggattcctgcacctctagcataagcaccccactgccctcagaggagccttcggtccctgctgactgcctggaggcagcacagcaactcaggaacagctctctgataggctgcatgtgccaccggcgcatgaagaaccaggttgcctgcttggacatctattggaccgttcaccgtgcccgcagccttgactcagacctctgcctcaagtttgccatgctgtgtactctcaatgacaagtgtgaccggctgcgcaaggcctacggggaggcgtgctccgggccccactgccagcgccacgtctgcctcaggcagctgctcactttcttcgagaaggccgccgagccccacgcgcagggcctgctactgtgcccatgtgcccccaacgaccggggctgcggggagcgccggcgcaacaccatcgcccccaactgcgcgctgccgcctgtggcccccaactgcctggagctgcggcgcctctgcttctccgacccgctttgcagatcacgcctggtggatttccagacccactgccatcccatggacatcctaggaacttgtgcaacagagcagtccagatgtctacgagcatacctggggctgattgggactgccatgacccccaactttgtcagcaatgtcaacaccagtgttgccttaagctgcacctgccgaggcagtggcaacctgcaggaggagtgtgaaatgctggaagggttcttctcccacaacccctgcctcacggaggccattgcagctaagatgcgttttcacagccaactcttctcccaggactggccacaccctacctttgctgtgatggcacaccagaatgaaaaccctgctgtgaggccacagccctgggtgccctctcttttctcctgcacgcttcccttgattctgctcctgagcctatggtagctggacttccccagggccctcttcccctccaccacacccaggtggacttgcagcccacaaggggtgaggaaaggacagcagcaggaaggaggtgcagtgcgcagatgagggcacaggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagccattctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgactt

SEQ ID NO: 136738 - DNA, 1427 bp, Homo sapiens
  Payload ID: 6774
  Gene Symbol: GFRA4
  Gene Name: GDNF family receptor alpha 4
  Uniprot ID: Q9GZZ7
  ENST ID: ENST00000290417
  CDS Start-End: 1-810
atggtccgctgcctggggcctgcgctgctgctgctgctgttactggggtcggcgagctcggtcggagggaaccgatgtgtggacgcggccgaagcctgcacggcggacgcgcggtgccagcgtttgcgctccgagtatgtggcgcagtgcctgggccgggctgcgcaggggggctgtccccgcgcccgctgccgccgggccctgcgccgcttcttcgcccgcgggccgcccgcgctcacccacgcactgctcttctgcccgtgcgcgggccccgcgtgcgccgagcgtcggcgccagaccttcgtgccctcctgcgccttttcggggcccggccccgcgccgccctcctgccttgagcccttaaacttctgcgagcgcagccgggtctgcaggcctcgcctcctggcctttcaggtctcgtgcaccccagcgcccagcgcccccgacggctgcctgctggaccagggcgcccgctgcctgcgcgcctacgcgggcctcgtgggcaccgccgtcacccctaactacgtggacaacgtgagcgcgcgcgtggcgccctggtgcgactgcggagccagcgggaaccggcgtgaggactgcgaagccttccgggggctctttaccaggaaccgctgcttggatggtgccattcaggcctttgccagcgggtggcccccagtcctgctggaccagctgaacccccagggagacccggagcacagcctcctgcaggtgtcctccacaggcagggccctggagagacgctccctgctctccatacttcctgtcctggctctcccggccctgctctgattaggacagcgacctcggatagcacagccagctactccaccctgcctgcctgggccgcctctgtggcctactggccccttgagaaggggctggcttaccccccaagccggccctggtgctttcactccgctgccctttgtaggtttggacaccctgtgtgccgtcccctggggcaagggatgtaggctggggcctgactgtaaagcccccgtctccctgtcaggaggcatcttggttgtaagtccctttattcacagaccttgagaccactggggtctcccacaaggtggggtcaggagagggtcacttttgtagctgagacctctctggagacccagatcccctagagcaggtcagagaccatccagaatcccagaattctaggaaattgtatcagcctcccaagcatataaccccctaaggaatccatcggacaagaccccgtctaacactgcatcctcccaactgggcattacccaccattgtagccacctgtgcgccatgaccatgctggcagagtctttcctgttccccatatgctgcttgaggggccccaccctgtgccctgcctggcattggccctgtggccatcttccccctggtttcctgcagctgta

SEQ ID NO: 136739 - DNA, 900 bp, Homo sapiens
  Payload ID: 6774
  Gene Symbol: GFRA4
  Gene Name: GDNF family receptor alpha 4
  Uniprot ID: Q9GZZ7
  ENST ID: ENST00000319242
  CDS Start-End: 1-900
atggtccgctgcctggggcctgcgctgctgctgctgctgttactggggtcggcgagctcggtcggagggaaccgatgtgtggacgcggccgaagcctgcacggcggacgcgcggtgccagcgtttgcgctccgagtatgtggcgcagtgcctgggccgggctgcgcaggggggctgtccccgcgcccgctgccgccgggccctgcgccgcttcttcgcccgcgggccgcccgcgctcacccacgcactgctcttctgcccgtgcgcgggccccgcgtgcgccgagcgtcggcgccagaccttcgtgccctcctgcgccttttcggggcccggccccgcgccgccctcctgccttgagcccttaaacttctgcgagcgcagccgggtctgcaggtgcgcgcgggcggcggcggggccgtggcgagggtggggacggggcctctctccggctcaccgccctcccgccgcgcaggcctcgcctcctggcctttcaggtctcgtgcaccccagcgcccagcgcccccgacggctgcctgctggaccagggcgcccgctgcctgcgcgcctacgcgggcctcgtggggtccccgcaggcaccgccgtcacccctaactacgtggacaacgtgagcgcgcgcgtggcgccctggtgcgactgcggagccagcgggaaccggcgtgaggactgcgaagccttccgggggctctttaccaggaaccgctgcttggatggtgccattcaggcctttgccagcgggtggcccccagtcctgctggaccagctgaacccccagggagacccggagcacagcctcctgcaggtgtcctccacaggcagggccctggagagacgctccctgctctccatacttcctgtcctggctctcccggccctgctctga

SEQ ID NO: 136740 - DNA, 549 bp, Homo sapiens
  Payload ID: 6774
  Gene Symbol: GFRA4
  Gene Name: GDNF family receptor alpha 4
  Uniprot ID: Q9GZZ7
  ENST ID: ENST00000477160
  CDS Start-End: 1-549
atggtccgctgcctggggcctgcgctgctgctgctgctgttactggggtcggcgagctcggtcggagggaaccgatgtgtggacgcggccgaagcctgcacggcggacgcgcggtgccagcgtttgcgctccgagtatgtggcgcagtgcctgggccgggctgcgcaggggggctgtccccgcgcccgctgccgccgggccctgcgccgcttcttcgcccgcgggccgcccgcgctcacccacgcactgctcttctgcccgtgcgcgggccccgcgtgcgccgagcgtcggcgccagaccttcgtgccctcctgcgccttttcggggcccggccccgcgccgccctcctgccttgagcccttaaacttctgcgagcgcagccgggtctgcaggcctcgcctcctggcctttcaggtctcgtgcaccccagcgcccagcgcccccgacggctgcctgctggaccagggcgcccgctgcctgcgcgcctacgcgggcctcgtggggtccccgcaggcaccgccgtcacccctaactacgtggacaacgtga

SEQ ID NO: 136741 - DNA, 1911 bp, Homo sapiens
  Payload ID: 6775
  Gene Symbol: GFRAL
  Gene Name: GDNF family receptor alpha like
  Uniprot ID: Q6UXV0
  ENST ID: ENST00000340465
  CDS Start-End: 87-1271
ttattctggacagttactcttaagaaagttgtcagaagaaacgcatctgcctttttttccaggtgaactgccgtgagttgtccagcatgatagtgtttattttcttggctatggggttaagcttggaaaatgaatacacttcccaaaccaataattgcacatatttaagagagcaatgcttacgtgatgcaaatggatgtaaacatgcttggagagtaatggaagatgcctgcaatgattcagatccaggtgacccctgcaagatgaggaattcatcatactgtaacctgagtatccagtacttagtggaaagcaatttccaatttaaagagtgtctttgcactgatgacttctattgtactgtgaacaaactgcttggaaaaaaatgtatcaataaatcagataacgtgaaagaggataaattcaaatggaatctaactacacgttcccatcatggattcaaagggatgtggtcctgtttggaagtggcagaggcatgtgtaggggatgtggtctgtaatgcacagttggcctcttaccttaaagcttgctcagcaaatggaaatccgtgtgatctgaaacagtgccaagcagccatacggttcttctatcaaaatataccttttaacattgcccagatgttggctttttgtgactgtgctcaatctgatataccttgtcagcagtccaaagaagctcttcacagcaagacatgtgcagtgaacatggttccaccccctacttgcctcagtgtaattcgcagctgccaaaatgatgaattatgcaggaggcactatagaacatttcagtcaaaatgctggcagcgtgtgactagaaagtgccatgaagatgagaattgcattagcaccttaagcaaacaggacctcacttgttcaggaagtgatgactgcaaagctgcttacatagatatccttgggacggtccttcaagtgcaatgtacctgtaggaccattacacaaagtgaggaatctttgtgtaagattttccagcacatgcttcatagaaaatcatgtttcaattatccaaccctgtctaatgtcaaaggcatggcattgtatacaagaaaacatgcaaacaaaatcactttaactggatttcattcccccttcaatggagaagtaatctatgctgccatgtgcatgacagtcacctgtggaatccttctgttggttatggtcaagcttagaacttccagaatatcaagtaaagcaagagatccttcatcgatccaaatacctggagaactctgattcattaggagtcatggacctataacaatcactcttttctctgcttttcttctttcctcttttcttctctcctctcctctcctctcttctcctctcctcccctcccctctctgtttctttttctttttcttttcttttttgtggcggagttttgctcttgttgcccaggctgcagtacaatggctcaatctcggttcactgcaacctctgcctccaaggttcaagtgattttcctgcctcagccttcccgagtagctgggattacaggtacccgccaccacgcccagctaatttttttgtatttttagtagagatggggttttgccaaattggccagggtggtctcaaactcctgacctcaggtgatccacccacctcggcctcccaaagtgctgggattacaggcgtgagcaaccacgtcaagacaacaatcactttctttaaagcaaatcctacagctggtcaacaccctattccatctgtcatcgagaaagaaaatgttaaaatagacttaaaaatattgctttgttacatataataatatggcatgatgatgttatttttttcttaatactcaagaaaaaatatatggtggtatcttttacaacactggaacagaaataaagtttcccttgaaggc

SEQ ID NO: 136742 - DNA, 4835 bp, Homo sapiens
  Payload ID: 6776
  Gene Symbol: GZF1
  Gene Name: GDNF-inducible zinc finger protein 1
  Uniprot ID: Q9H116
  ENST ID: ENST00000338121
  CDS Start-End: 78-2213
gttcctaccggcctggtccagcggacagcggctgcagcgggggcgccggctgggagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaac

SEQ ID NO: 136743 - DNA, 4740 bp, Homo sapiens
  Payload ID: 6776
  Gene Symbol: GZF1
  Gene Name: GDNF-inducible zinc finger protein 1
  Uniprot ID: Q9H116
  ENST ID: ENST00000377051
  CDS Start-End: 1-2136
atggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaagg

SEQ ID NO: 136744 - DNA, 795 bp, Homo sapiens
  Payload ID: 6776
  Gene Symbol: GZF1
  Gene Name: GDNF-inducible zinc finger protein 1
  ENST ID: ENST00000424216
  CDS Start-End: 650-795
ggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggccca

SEQ ID NO: 136745 - DNA, 2474 bp, Homo sapiens
  Payload ID: 6777
  Gene Symbol: GDI1
  Gene Name: GDP dissociation inhibitor 1
  Uniprot ID: P31150
  ENST ID: ENST00000447750
  CDS Start-End: 336-1679
ctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 136746 - DNA, 568 bp, Homo sapiens
  Payload ID: 6777
  Gene Symbol: GDI1
  Gene Name: GDP dissociation inhibitor 1
  ENST ID: ENST00000445564
  CDS Start-End: 102-224
atctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgagcggaggcaggtgggagtgcagcggatggtgtcaccctcccccaggaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttc

SEQ ID NO: 136747 - DNA, 560 bp, Homo sapiens
  Payload ID: 6777
  Gene Symbol: GDI1
  Gene Name: GDP dissociation inhibitor 1
  ENST ID: ENST00000415109
  CDS Start-End: 90-230
gtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccatgcctctcggcgtgttggtactggaaggccatcctgtgtctgctggatgccctgcctccctcaaagcctccgttatttcactctccgccttgtgagggggacgggactcctttgcccagcaaggttgcaatggagagtgtggtcggatgaagccatcaccccaattttaggaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctg

SEQ ID NO: 136748 - DNA, 816 bp, Homo sapiens
  Payload ID: 6777
  Gene Symbol: GDI1
  Gene Name: GDP dissociation inhibitor 1
  ENST ID: ENST00000434049
  CDS Start-End: 92-535
cagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaggcctccactgaatccccgagacatcgccaagtgtctgagccaggaaggcccttagagcccatccaggccaatcccctcttcatccagatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacc

SEQ ID NO: 136749 - DNA, 786 bp, Homo sapiens
  Payload ID: 6777
  Gene Symbol: GDI1
  Gene Name: GDP dissociation inhibitor 1
  ENST ID: ENST00000630693
  CDS Start-End: 343-786
attcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaggcctccactgaatccccgagacatcgccaagtgtctgagccaggaaggcccttag

SEQ ID NO: 136750 - DNA, 584 bp, Homo sapiens
  Payload ID: 6778
  Gene Symbol: GDI2
  Gene Name: GDP dissociation inhibitor 2
  ENST ID: ENST00000380127
  CDS Start-End: 140-584
gaagcccccggaagcctccccagaagctgttgccggtgctatgcgacctgtacagcctgcagaaccaaagatccatggtccaatataacatatcttcttcaagtatttatggggtaacatcccaaaataacacttttagatgtctctaggcaagagaaaaccttcgaacttttatttggctaattttttaggaaaggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctag

SEQ ID NO: 136751 - DNA, 1408 bp, Homo sapiens
  Payload ID: 6778
  Gene Symbol: GDI2
  Gene Name: GDP dissociation inhibitor 2
  Uniprot ID: P50395
  ENST ID: ENST00000380181
  CDS Start-End: 154-1356
tggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataa

SEQ ID NO: 136752 - DNA, 2412 bp, Homo sapiens
  Payload ID: 6778
  Gene Symbol: GDI2
  Gene Name: GDP dissociation inhibitor 2
  Uniprot ID: P50395
  ENST ID: ENST00000380191
  CDS Start-End: 292-1629
agagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggctttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 136753 - DNA, 834 bp, Homo sapiens
  Payload ID: 6778
  Gene Symbol: GDI2
  Gene Name: GDP dissociation inhibitor 2
  ENST ID: ENST00000447751
  CDS Start-End: 1-612
aagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattatta

SEQ ID NO: 136754 - DNA, 636 bp, Homo sapiens
  Payload ID: 6778
  Gene Symbol: GDI2
  Gene Name: GDP dissociation inhibitor 2
  ENST ID: ENST00000418688
  CDS Start-End: 172-636
ttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacgttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactt

SEQ ID NO: 136755 - DNA, 918 bp, Homo sapiens
  Payload ID: 6778
  Gene Symbol: GDI2
  Gene Name: GDP dissociation inhibitor 2
  ENST ID: ENST00000456041
  CDS Start-End: 130-918
cagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatgaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaa

SEQ ID NO: 136756 - DNA, 634 bp, Homo sapiens
  Payload ID: 6778
  Gene Symbol: GDI2
  Gene Name: GDP dissociation inhibitor 2
  ENST ID: ENST00000608581
  CDS Start-End: 244-634
attcacctgcttaggctttcgtggggtcggcctcttggagctgagaacacagcttctgcttacacctgtgtcctcaatgaagccagagattcctaagagaattctagaaaaagaggagcggggtagaaggcaagcaaggaacagtttctaagcttagggcctaaacctttgcatacaaggatcagctaccacgtttacagcggctttaagttacagccctcggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaa

SEQ ID NO: 136757 - DNA, 622 bp, Homo sapiens
  Payload ID: 6778
  Gene Symbol: GDI2
  Gene Name: GDP dissociation inhibitor 2
  ENST ID: ENST00000609712
  CDS Start-End: 246-622
ttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggtaacatcccaaaataacacttttagatgtctctaggcaagagaaaaccttcgaacttttatttggctaattttttaggaaaggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccac

SEQ ID NO: 136758 - DNA, 1193 bp, Homo sapiens
  Payload ID: 6779
  Gene Symbol: GDPGP1
  Gene Name: GDP-D-glucose phosphorylase 1
  Uniprot ID: Q6ZNW5
  ENST ID: ENST00000329600
  CDS Start-End: 22-1179
tgactatttcaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcatcccagatgctctgccacaatctccctttgatgctgcactctgctctgcctggaagcagcgggtggagctggggctgtttcgctaccgtctacgggagctacagacccaaatcctccctggtgctgtgggtttcgtggctcagctgaatgtggagcgtggtgtgcagaggaggcccccgcagaccatcaagagtgtgaggcaggcatttgaccctgtacagttcaacttcaacaagatccggcccggagaagtcctcttccgtttgcaccgggagcctgatctccctgggactctgctgcaagaagacatcctggtggtgatcaacgtcagccccctggagtggggccacgtgctgctggtgcctgagcctgcccgccagctcccccagcgcctgctgccgggtgcactgagggcagggattgaggctgtgctgctgagcttacacccgggcttccgtgtcggcttcaacagcctgggaggcttggcctcggtgaaccacctccacctgcatggctattacctggcccacagactgcccgtggagcaggcgccaagcgagcccctggaccctggaggccatttgcatctgctccaggacctcccagctcctggcttcctcttttacactcgtgggccagggcctgacttggagtccttgataagcagggtatgtcgggccactgattatctgactgaccatgagattgctcataacttgtttgtcacccggggagctccgccgggaaagacatcaccttcctcagccctcacaggggtccgagtaattctgtgggcccggaagtccagctttgggataaaggacggtgaagctttcaatgttgccctctgtgagctggctgggcacctccctgtcaaaacatcccaggacttcagcagcctgacagaggcagctgctgtggccctcattcaggactgtcggctgcccccatcccaggcagaagacgtacaggcagcactggtggccctgatgtcccaggaagagcaataatacttctggatgta

SEQ ID NO: 136759 - DNA, 5323 bp, Homo sapiens
  Payload ID: 6779
  Gene Symbol: GDPGP1
  Gene Name: GDP-D-glucose phosphorylase 1
  Uniprot ID: Q6ZNW5
  ENST ID: ENST00000558017
  CDS Start-End: 421-1578
ctccccagggccaggcgtcccgcgcacctggtactcggccagcagctccttggacaggcgactgcccgagccccccatcgccccgccgcgcgcacagctccgccaactcgcctcgagacgcagacaactttctcacttccgcccttgggccgcgtcactgcccggtccccgcggcaaccgctcctggggccaccacccccgggcccgccccctcctaaaagctgccaggcgttcccagccgggtttggcaggcgagctgccggctccaagcggtcctaggctatttactgaggacccactggatgtcaagcattgtgcatagttttcttcgattgttgcaacatcccttgcgagtttctggagcagcagagctgaaggaacccaaacttggactgaagtgactctactaaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcatcccagatgctctgccacaatctccctttgatgctgcactctgctctgcctggaagcagcgggtggagctggggctgtttcgctaccgtctacgggagctacagacccaaatcctccctggtgctgtgggtttcgtggctcagctgaatgtggagcgtggtgtgcagaggaggcccccgcagaccatcaagagtgtgaggcaggcatttgaccctgtacagttcaacttcaacaagatccggcccggagaagtcctcttccgtttgcaccgggagcctgatctccctgggactctgctgcaagaagacatcctggtggtgatcaacgtcagccccctggagtggggccacgtgctgctggtgcctgagcctgcccgccagctcccccagcgcctgctgccgggtgcactgagggcagggattgaggctgtgctgctgagcttacacccgggcttccgtgtcggcttcaacagcctgggaggcttggcctcggtgaaccacctccacctgcatggctattacctggcccacagactgcccgtggagcaggcgccaagcgagcccctggaccctggaggccatttgcatctgctccaggacctcccagctcctggcttcctcttttacactcgtgggccagggcctgacttggagtccttgataagcagggtatgtcgggccactgattatctgactgaccatgagattgctcataacttgtttgtcacccggggagctccgccgggaaagacatcaccttcctcagccctcacaggggtccgagtaattctgtgggcccggaagtccagctttgggataaaggacggtgaagctttcaatgttgccctctgtgagctggctgggcacctccctgtcaaaacatcccaggacttcagcagcctgacagaggcagctgctgtggccctcattcaggactgtcggctgcccccatcccaggcagaagacgtacaggcagcactggtggccctgatgtcccaggaagagcaataatacttctggatgtatttatgttctttttttcttttcttttgagatagggtctcactctgtccccaggctagagtgtagtggtatgatcctggctcactgtagcctccacctctggggctgaagtgatcctcccacctcagcctcttgagtagctgagactataggcgtgcaccaccacacacctggctttttttttttttttttttttttttaacgattaggtgattttgtatttttttatatagacagcgtttcaccatgttgcccaggctggtcttgaactcttgggctgaagcagtcctcccacctcggcctcccaaagtactgagatgacaggagtgagcccctggattcttttctgtttctttttttttttttttttttttttttttttttgagatagtctcgctctgtcacctaggttggggtgcactggtacaatctcggctcactgcaacctccacctctagggttcgagtgatcctcctggctcagcctcccgagtagctgggactatacaggctcctgccaccaaacccggctaatttttttgtatttttaaaagagaaggggtttcaccacattggctaggctggtcttgaactcctgactttaggtgatccgcccgcctcggcctcccaaagtgctgggattacaggcgtgagccaccacacccagccaggatgtattcattttctacctgatgagtccctttccagagcactgtccatcatagtcctttggacatttattttcatggctgccttctcacctgtctcagcctaagaagaaggatgaagaaagctgataatgatctcttaaaggggagaaagataatggtctctttaaaggggagctgatagtggtctctttaaaggggagaaaatctggaataattctactgagtaagacatcatgaatgtatctgctacctctccccgttcttgttcaagccccaggggtgttaaaaaggagtgtgtgtgacagttacacactcctgactttacatttagattttgtcttcctttgatatcaaatgttagcacggtaatagtgcctgtgcctccagtattgagctgccacttctgttctcagcctgtttattcccctttgctcaccacttatttttattgctttgtcccttctttccatttagccctgctccacccaaatgccccactccttcactttccctgccaccttgagctttcctctagcccccaacaccaagttgaatgctcttcactgacatcatctgatgtaaaaacacagtgttgtcacaactttccgggtgcacgtctttttttgttttgtttttttgtaaggctggggtgcagtggtgcaatcacagctcactgcagacccaaactcttggtctcaagccaccctcccacctcagccccctgagtagctgggacgataggtgtgcaccatcacacctggctaatttttaaattttttgtagagatagggtcttgctatgttgcccgggttgctgtcaaactcctggccttaagaaatcctcccacctcggcctcccagagtgctaagatgccaccacaccttggtgcaggttttttttttttttttttttttttttttttgacacagggtcactgtcacccaggctggagtgcagtggtatgaagacagctaactgcaagcttcaacctcctgggctcaaacaatactcccatctcagcctccctagtagctgggaccacaggcatgcgccaccacacccggctatttttttggagagatagcatcttgccaagttgcccaggctggtctcgaactcctggcctcaagatcctcccacctcagcctcccaaagtgctgagattataggcatgagccactgcacctggcctgagtttttttttttttttcttgaatcagagtttcactctgttgcccaggctggagtgcagtggtgtgatctcggctcactgcgtctctgcctcctgggttcaagcaattcagcctgagtcttcttaatacccccattcaaaacgggatggagactgacagtttgtactttgttcaaggtcaggcagctggagtcgggactgcagcacaggcaggtaccagaagatgagctgggacaatgtgtgcttgtgaccgcctctccagtcagtggttcccatggtgggtagcactgtccttaacagtttgccctccctgagcctcagccatccctcttggggtctttcccaagcactttagaagctcctcttgatgtagacacaaaatccaaagctaagtcgttgttcctccgtctgcatctgagtcaatgtgggaaatttttttttatctcattgctttgttctgtcctgtttctccagacatttcacactggttccagaggaactagtcagtagacactattctaagagagtatgtgggtgtgaaatctcattttccttttagctcccttgaatgttatacagcaaaagtaaaagaagtcttgggttggctgggcacgttggctcacacctttaatcctagcactttgggaagccgaggcaggcaaatcacttgtcaggagttcgagaccagcctggccaacatggtgaaaccccatctctactaaaaatacaaaaattaggcgttgtggcggccacctgtaatcccatctacttgggaggctgaggcaggagaatcacttgaacccaggaggcggaggttgcagtgagctgagattgcacgactgtactccagcctgggcgatagtgcgagactcagtctcaaaataaataaatacataaagtcttgggtccagctctcaacagagattatcaccgccaccactccttcatcaaacatcctgaaggaatgagagtccctgttcacagcgtaagggtgaaagggggctcacacaggtgggttctggctgctgtctgagtgggctcacccaggaggggttttgatttctctgcctcccaaactgtgggtcctagccctggcttaggccttcaggtcgttggctccctatacctaggcctgtataaagccttagtttccagttttcattagaggttttacatcccaaatgatgttacaaagtctccctgtgataaagcagaatatgtgtccatagcccattttataagaaaaacagtttaggccaggtgcggtggctcacgcctgtaatcccagcactttgggaggctgaagcaggcagatcacaaggtcaggagttcaagaccagcctggccaacatggtgaaaccccgtctctactaaaaacacaaaaattagctgggtgtgggtgcacatctatagtcccagctactcaggaggctgaggcaggagaatcgcttggacctgggaggcggaggtggcagtgagccgagatcgcgccactgcactccagcctgggcggcagagagagactttgtctcaaaaaaaaaaaaaaagaaaaaaacagtttaccattctatcagaaaatgttgaccaccctcatatttttggtaaactgcagtaatttttccttaatactttttgcaagcttttgcatgcataagctccagtatcacacttaattttgcttgcttgctctctgaagggagttcggatgaccattacagcaaagtggattttgcgttcaaagtgataagccaaatatcaggattttcccagtttctccgtaggactgatgtttagaggaaagccttccctgactcaaatatgtttctccatataaaaaggggaaagtaaaatgggttttctttctggtggta

SEQ ID NO: 136760 - DNA, 504 bp, Homo sapiens
  Payload ID: 6779
  Gene Symbol: GDPGP1
  Gene Name: GDP-D-glucose phosphorylase 1
  ENST ID: ENST00000561433
  CDS Start-End: 356-504
gtgctggctgcgtatgcgtcacgggcgtcatgacctcgctgtggccccggcagcggctgcggggaaagtcgcgaggtgcatccgcttcggctgcagctatttactgaggacccactggatgtcaagcattgtgcatagttttcttcgattgttgcaacatcccttgcgagagtttcactcctgttgcccaggctggagtgcaatggcatgatctcagctcaccgcaacctccgcctcctgagttcaagcagttctcctgcctcagcctcctgaatagctcggattacagtttctggagcagcagagctgaaggaacccaaacttggactgaagtgactctactaaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcat

SEQ ID NO: 136761 - DNA, 850 bp, Homo sapiens
  Payload ID: 6779
  Gene Symbol: GDPGP1
  Gene Name: GDP-D-glucose phosphorylase 1
  ENST ID: ENST00000559204
  CDS Start-End: 209-850
catgacctcgctgtggccccggcagcggctgcggggaaagtcgcgaggtgcatccgcttcggctgcagctatttactgaggacccactggatgtcaagcattgtgcatagttttcttcgattgttgcaacatcccttgcgagtttctggagcagcagagctgaaggaacccaaacttggactgaagtgactctactaaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcatcccagatgctctgccacaatctccctttgatgctgcactctgctctgcctggaagcagcgggtggagctggggctgtttcgctaccgtctacgggagctacagacccaaatcctccctggtgctgtgggtttcgtggctcagctgaatgtggagcgtggtgtgcagaggaggcccccgcagaccatcaagagtgtgaggcaggcatttgaccctgtacagttcaacttcaacaagatccggcccggagaagtcctcttccgtttgcaccgggagcctgatctccctgggactctgctgcaagaagacatcctggtggtgatcaacgtcagccccctggagtggggccacgtgctgctggtgcctgagcctgcccgccagctcccccagcgcctgctgccgggtgcactgagggcagggattgaggctgtgctgctgagcttacacccgggcttccgtgtcggcttcaacagcctgggaggcttggcctcggtg

SEQ ID NO: 136762 - DNA, 550 bp, Homo sapiens
  Payload ID: 6779
  Gene Symbol: GDPGP1
  Gene Name: GDP-D-glucose phosphorylase 1
  ENST ID: ENST00000558291
  CDS Start-End: 520-550
aagtcgcgaggtgcatccgcttcggctgcagtaggtggtggcggcggcagccctgggtggggtcccataggggcatctgagaagtcactggagctagcgtttccgggaaacctggagactcgctgagtggcgggggtcgtcggctgcccctctgcccagcaagggcttttctagatgttatcatcaggcaatcgctgcacctgtcgcagcccccaagccacctcttccagaagtaaccataaccttgcttccttcttaggctatttactgaggacccactggatgtcaagcattgtgcatagttttcttcgattgttgcaacatcccttgcgagagtttcactcctgttgcccaggctggagtgcaatggcatgatctcagctcaccgcaacctccgcctcctgagttcaagcagttctcctgcctcagcctcctgaatagctcggattacagtttctggagcagcagagctgaaggaacccaaacttggactgaagtgactctactaaggtcagctctatggctcttccacatgattcaaacgaaactt

SEQ ID NO: 136763 - DNA, 1752 bp, Homo sapiens
  Payload ID: 6780
  Gene Symbol: GMDS
  Gene Name: GDP-mannose 4,6-dehydratase
  Uniprot ID: O60547
  ENST ID: ENST00000380815
  CDS Start-End: 271-1389
gacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 136764 - DNA, 1440 bp, Homo sapiens
  Payload ID: 6780
  Gene Symbol: GMDS
  Gene Name: GDP-mannose 4,6-dehydratase
  Uniprot ID: O60547
  ENST ID: ENST00000530927
  CDS Start-End: 49-1077
tgtacacaggcagtttgttgggagcgttaccattgcctctggttcctcatgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 136765 - DNA, 1544 bp, Homo sapiens
  Payload ID: 6781
  Gene Symbol: GMPPA
  Gene Name: GDP-mannose pyrophosphorylase A
  Uniprot ID: Q96IJ6
  ENST ID: ENST00000313597
  CDS Start-End: 93-1355
cttgcgagaagacacgtgcgcggaaggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttg

SEQ ID NO: 136766 - DNA, 1524 bp, Homo sapiens
  Payload ID: 6781
  Gene Symbol: GMPPA
  Gene Name: GDP-mannose pyrophosphorylase A
  Uniprot ID: Q96IJ6
  ENST ID: ENST00000341142
  CDS Start-End: 73-1335
gagctggagtgaagggagctagtggtaaagggagctggtggaggggtggcggcaggggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttg

SEQ ID NO: 136767 - DNA, 1823 bp, Homo sapiens
  Payload ID: 6781
  Gene Symbol: GMPPA
  Gene Name: GDP-mannose pyrophosphorylase A
  Uniprot ID: Q96IJ6
  ENST ID: ENST00000358215
  CDS Start-End: 370-1632
agtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttgga

SEQ ID NO: 136768 - DNA, 1501 bp, Homo sapiens
  Payload ID: 6781
  Gene Symbol: GMPPA
  Gene Name: GDP-mannose pyrophosphorylase A
  Uniprot ID: Q96IJ6
  ENST ID: ENST00000373908
  CDS Start-End: 49-1311
cgggcggcagagctggagtgaagggagctagtggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttgg

SEQ ID NO: 136769 - DNA, 1630 bp, Homo sapiens
  Payload ID: 6781
  Gene Symbol: GMPPA
  Gene Name: GDP-mannose pyrophosphorylase A
  Uniprot ID: Q96IJ6
  ENST ID: ENST00000373917
  CDS Start-End: 72-1493
ggaaggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgaggtacccagcctgccccaattcctaacctttggcttccaccccagccctctgaaccaggattcttgacctcgagtccagagttaaagcctcaatccctgccccttcctgatcaaattcggtttgggatatttgcccccagggcctctcttctgcttctagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctgg

SEQ ID NO: 136770 - DNA, 907 bp, Homo sapiens
  Payload ID: 6781
  Gene Symbol: GMPPA
  Gene Name: GDP-mannose pyrophosphorylase A
  ENST ID: ENST00000455657
  CDS Start-End: 369-907
gggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaa

SEQ ID NO: 136771 - DNA, 1783 bp, Homo sapiens
  Payload ID: 6781
  Gene Symbol: GMPPA
  Gene Name: GDP-mannose pyrophosphorylase A
  ENST ID: ENST00000443704
  CDS Start-End: 366-1238
gcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggcctctcttctgcttctagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcct

SEQ ID NO: 136772 - DNA, 786 bp, Homo sapiens
  Payload ID: 6781
  Gene Symbol: GMPPA
  Gene Name: GDP-mannose pyrophosphorylase A
  ENST ID: ENST00000435316
  CDS Start-End: 39-786
gcggcagagctggagtgaagggagctagtggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgag

SEQ ID NO: 136773 - DNA, 1473 bp, Homo sapiens
  Payload ID: 6781
  Gene Symbol: GMPPA
  Gene Name: GDP-mannose pyrophosphorylase A
  ENST ID: ENST00000622191
  CDS Start-End: 22-1221
gtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggaggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttgg

SEQ ID NO: 136774 - DNA, 571 bp, Homo sapiens
  Payload ID: 6781
  Gene Symbol: GMPPA
  Gene Name: GDP-mannose pyrophosphorylase A
  ENST ID: ENST00000480034
  CDS Start-End: 1-343
catccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggtatggcttcctgggggccagggctgggggaacccctcagctgatggccagtggccccggggagcattcgttcctctgtgtgcacgcgtgtttcttcttttagcaaacagttaccaagggcctgctgtgtgccaggccctgtgtgagtcaccgggggcatgagaccaggggcacagatgggcaggagggctccctccctgctggcagtggcccccagctccctgcccctgtctcccctcccatgacctcccctggtgccctcatccatgctg

SEQ ID NO: 136775 - DNA, 3217 bp, Homo sapiens
  Payload ID: 6782
  Gene Symbol: GMPPB
  Gene Name: GDP-mannose pyrophosphorylase B
  Uniprot ID: Q9Y5P6
  ENST ID: ENST00000308375
  CDS Start-End: 226-1389
gagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtaagcctgtgggctgggctgggtggggagaggggcggggagtgtgcctgcctccctgacaaggcctatcctctcctggaggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagc

SEQ ID NO: 136776 - DNA, 1582 bp, Homo sapiens
  Payload ID: 6782
  Gene Symbol: GMPPB
  Gene Name: GDP-mannose pyrophosphorylase B
  Uniprot ID: Q9Y5P6
  ENST ID: ENST00000308388
  CDS Start-End: 224-1306
gttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctca

SEQ ID NO: 136777 - DNA, 6108 bp, Homo sapiens
  Payload ID: 6782
  Gene Symbol: GMPPB
  Gene Name: GDP-mannose pyrophosphorylase B
  Uniprot ID: Q9Y5P6
  ENST ID: ENST00000480687
  CDS Start-End: 118-1200
gagttcggggccagcagccgtctacccggtgtcgcgttctgtgttgtggcggccctggatccggcgtcagggcgaccgggcggacgaggtggagccagagtctgtcaggcgggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagacattcttccagactcccccttttactccccgaggaaaaacgagcggcggagagctgccagccaaaggctgacggggactttggggttggccttgctccccatctggcggtcatgcggggccattgggcacaaagggatgtagccgccccgcctcctcaaacgggaaccaataggagcccgggccccgcccctggggggagtatttaggagccgatcaggaactcgcttggagagggctagcgaagccgaagggagcgcggctaagagtgccgcaccgcctcacaacctgggaaccggagagtaggggccgtcggctggcaagaacccgccgtgcctcctcggcaagggccatccggtgccacccatgtcgcactagagcagaagagggtgagtcctggaactgcaacctgcacagagctgctctgtactgtccctggtggtcgccgccatgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctagagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgccgctgccgccgctggccccaaacacccagcccgctccaagagctgagcgcacagtcctcagtactcagcaccacaccgccagacgcacccagccgcaaggccagcgtccacaagcacgtagtctttctggagccaggccggaggggcctcaatggccgcgtgcagctggcagtagctgaggaattcgatctctacaaccctggaggcctgcagctgaaggctggctctgagtccgccagctccataggctccgagggtcccatgacaacctagactgcccagggctcccccacccaggcccccaccctcttgctgctcgccctgctccctgcttcggtccagagaactggcagatactggtgggaagcactgtgcctggccccccagcttcctgtatgggcctcgaaacacaatgggccttctcgctcactggtagagacaggggttgtggtccccaacctgccttctgctctgcccctgcacaggacccaaaggccccaggccctgcaaggtgtgctagttcctgctttcccgcggacttcctagtgcccaaatgccctgtgaggctgagagacccaggcccctgtggctttcaacacagcacagctgtggaagtggctgtgttcttctacagcctgtggaagaacccctgtagcagagcctcccgtccaccctcaggggctgagacagctctcgaggagtggtgctcaagagctgacgcagggccacctccccttcccaagggggtgggagggagtgggcccacagggaaaagaaggcggctctgaaggaagatctcgcccacaccccaggacagaaagaggaaacaagcccgccctctggtgaaatgggactccctccatccaccaacacccaacctcctgaaagcttcacaacttcacgcagagtccggtgggcaggcaccaggcaggaaaggctcctcaagaggttcctggtggtctggcctaagccccagccagaggccctgctctctctggcctggggcatccacccgttgttctgaaggcagagcccattctgtgggctcacaagacacagtgaaggggatcatggcctgcacccctgcttttcagcagtaaaaagcccgaaaagcctggcgagcatggccgagctgggagggccgagccggaactccacgtccctcgagagcaggagcctcttaagggctggcactggtctcagcctaatggctgaggcggtaccctggcttcatatgcatctcactgctcccactgcaggggggcagggaaggggggtctgggagcccttcatgtgtgggggccgagctgggggcccccatggccatcctggacctcgctgctccagagtttaataaaggtagcacatgcttattgctag

SEQ ID NO: 136778 - DNA, 2655 bp, Homo sapiens
  Payload ID: 6783
  Gene Symbol: GSN
  Gene Name: gelsolin
  Uniprot ID: P06396
  ENST ID: ENST00000341272
  CDS Start-End: 221-2416
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 136779 - DNA, 879 bp, Homo sapiens
  Payload ID: 6783
  Gene Symbol: GSN
  Gene Name: gelsolin
  ENST ID: ENST00000373806
  CDS Start-End: 1-203
acaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctca

SEQ ID NO: 136780 - DNA, 2562 bp, Homo sapiens
  Payload ID: 6783
  Gene Symbol: GSN
  Gene Name: gelsolin
  Uniprot ID: P06396
  ENST ID: ENST00000373808
  CDS Start-End: 128-2323
tcccgcccgcgccctgcccaccccggccgcgcgcaccacaacgcccccgccccgccgcccggaaccagctgagcgcagctggacccagcagccgctgtctccagtgccgcagcagcagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 136781 - DNA, 2657 bp, Homo sapiens
  Payload ID: 6783
  Gene Symbol: GSN
  Gene Name: gelsolin
  Uniprot ID: P06396
  ENST ID: ENST00000373818
  CDS Start-End: 70-2418
gggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 136782 - DNA, 3341 bp, Homo sapiens
  Payload ID: 6783
  Gene Symbol: GSN
  Gene Name: gelsolin
  Uniprot ID: P06396
  ENST ID: ENST00000373823
  CDS Start-End: 906-3101
gctggagtgcaatggcacgatatcagctcactgaagcctccacctcctgggctcaagcactcctcccacctcagccccccaggtagctgagactacaggaatggataaagcacggagaggaaccaagaatgtgctcagaaaaaaatccttcctcactgaaaccaggactaaggaaaggagattcccttctaccatccatggactcaggctgacggagcacgctgcctgtctgtgtctctccgtttctctctctggaacgttgtcagatgtcacggcggagggaaaagagacctggaatgacttgccgaatttttagcccataaccaggcactgtgtaaaccgctttacctcattcagtctttgcaattataccacaaggtcacactgtttagaaggagaaagaagagctcgctgtgaaaaacgctccacaatgctgcagagccttgtgaaggtggaagagtactctcatcagcaaacggcattccttccatggaaaatgtcattgggaggaaagcaggttcaagtgattctcctgcctcagcctcctgagtagctgggattacagggacaaactacaaggcattcgatgctcaacaaatacttgtgctgataacttctctttctgaagccagctccaggagaggtctgtaatcagaagagcccctgaaccctgaagcctcctgggctgcccagcccaggcatctcctctcctcactctgggaaggaggtggtcttctggcaaaagaagatatcaaagttcttccatcagaggagatccttatcagcaagacattcactctgaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgt

SEQ ID NO: 136783 - DNA, 2311 bp, Homo sapiens
  Payload ID: 6783
  Gene Symbol: GSN
  Gene Name: gelsolin
  ENST ID: ENST00000394353
  CDS Start-End: 22-2268
atagctccccccagcctcgcgatggccgaggaagaagccctcaggggcaattctgacccatggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttgg

SEQ ID NO: 136784 - DNA, 1042 bp, Homo sapiens
  Payload ID: 6783
  Gene Symbol: GSN
  Gene Name: gelsolin
  ENST ID: ENST00000432226
  CDS Start-End: 263-1042
ctcccccacccgcctgcccggccgccccgccccgagggcggctcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtcc

SEQ ID NO: 136785 - DNA, 2767 bp, Homo sapiens
  Payload ID: 6783
  Gene Symbol: GSN
  Gene Name: gelsolin
  ENST ID: ENST00000449733
  CDS Start-End: 225-2528
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttaggagaaggggatgaatgaatacaggacttacgcgtctgctgtggcccagctggcttccagatggtgacatgagccacccacagccggagctgttcctctttcccaaagctcagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 136786 - DNA, 985 bp, Homo sapiens
  Payload ID: 6783
  Gene Symbol: GSN
  Gene Name: gelsolin
  ENST ID: ENST00000449773
  CDS Start-End: 301-985
ctcccccacccgcctgcccggccgccccgccccgagggcggctcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgagg

SEQ ID NO: 136787 - DNA, 2726 bp, Homo sapiens
  Payload ID: 6783
  Gene Symbol: GSN
  Gene Name: gelsolin
  Uniprot ID: P06396
  ENST ID: ENST00000436847
  CDS Start-End: 259-2487
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 136788 - DNA, 2734 bp, Homo sapiens
  Payload ID: 6783
  Gene Symbol: GSN
  Gene Name: gelsolin
  Uniprot ID: P06396
  ENST ID: ENST00000412819
  CDS Start-End: 300-2495
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttaggccttggttgctattctgtagaagagcagagtccccataaagaggaggtgcaggaattcttcccagaggctttggagagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 136789 - DNA, 2428 bp, Homo sapiens
  Payload ID: 6783
  Gene Symbol: GSN
  Gene Name: gelsolin
  Uniprot ID: P06396
  ENST ID: ENST00000545652
  CDS Start-End: 156-2375
gtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacacccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtcctt

SEQ ID NO: 136790 - DNA, 806 bp, Homo sapiens
  Payload ID: 6783
  Gene Symbol: GSN
  Gene Name: gelsolin
  ENST ID: ENST00000477104
  CDS Start-End: 111-806
atagctccccccagcctcgcgatggccgaggaagaagccctcaggggcaattctgacccatggttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccag

SEQ ID NO: 136791 - DNA, 1094 bp, Homo sapiens
  Payload ID: 6784
  Gene Symbol: GEMIN2
  Gene Name: gem (nuclear organelle) associated protein 2
  Uniprot ID: O14893
  ENST ID: ENST00000250379
  CDS Start-End: 1-798
atgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaagcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttg

SEQ ID NO: 136792 - DNA, 1420 bp, Homo sapiens
  Payload ID: 6784
  Gene Symbol: GEMIN2
  Gene Name: gem (nuclear organelle) associated protein 2
  Uniprot ID: O14893
  ENST ID: ENST00000308317
  CDS Start-End: 84-926
taacgctccctaaactgccacttgctcagctccgcgcctaaggtgtctattagtacgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaa

SEQ ID NO: 136793 - DNA, 801 bp, Homo sapiens
  Payload ID: 6784
  Gene Symbol: GEMIN2
  Gene Name: gem (nuclear organelle) associated protein 2
  Uniprot ID: O14893
  ENST ID: ENST00000396249
  CDS Start-End: 1-753
atgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggtattttgaccaacgtgatttagctgatgagccatcttgatgtagctgatctctcag

SEQ ID NO: 136794 - DNA, 825 bp, Homo sapiens
  Payload ID: 6784
  Gene Symbol: GEMIN2
  Gene Name: gem (nuclear organelle) associated protein 2
  Uniprot ID: O14893
  ENST ID: ENST00000412033
  CDS Start-End: 1-135
atgcgccgagcggaactggctggtttgaaaaccatggcgtgggtaccagcggagtccgcagtggaagagttgatgcctcggctattgccggatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaa

SEQ ID NO: 136795 - DNA, 630 bp, Homo sapiens
  Payload ID: 6784
  Gene Symbol: GEMIN2
  Gene Name: gem (nuclear organelle) associated protein 2
  ENST ID: ENST00000531684
  CDS Start-End: 1-136
actggctggtttgaaaaccatggcgtgggtaccagcggagtccgcagtggaagagttgatgcctcggctattgccggtagagccttgcgacttgacggaaggatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactg

SEQ ID NO: 136796 - DNA, 592 bp, Homo sapiens
  Payload ID: 6784
  Gene Symbol: GEMIN2
  Gene Name: gem (nuclear organelle) associated protein 2
  ENST ID: ENST00000527381
  CDS Start-End: 1-592
tgaaaaccatggcgtgggtaccagcggagtccgcagtggaagagttgatgcctcggctattgccggtagagccttgcgacttgacggaaggtttcgatccctcggtacccccgaggacgcctcaggaatacctgaggatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactcc

SEQ ID NO: 136797 - DNA, 658 bp, Homo sapiens
  Payload ID: 6784
  Gene Symbol: GEMIN2
  Gene Name: gem (nuclear organelle) associated protein 2
  ENST ID: ENST00000534684
  CDS Start-End: 1-658
ggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcagggaagatggctttatgctttattggcttgtcttgaaaagcctttgttacctgaggctcattcactgattcggcagcttgcaagaaggtgctctgaagtgaggctcttagtg

SEQ ID NO: 136798 - DNA, 1476 bp, Homo sapiens
  Payload ID: 6784
  Gene Symbol: GEMIN2
  Gene Name: gem (nuclear organelle) associated protein 2
  ENST ID: ENST00000525153
  CDS Start-End: 22-471
gctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgaggtggggttttgccatgttggccaggctggtcttgaactcctgacttcatgtgatcgcctgcctcggcctcccaaagtgctgggattacaggcgtgaaccaccgcacccggcctaagccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaa

SEQ ID NO: 136799 - DNA, 649 bp, Homo sapiens
  Payload ID: 6784
  Gene Symbol: GEMIN2
  Gene Name: gem (nuclear organelle) associated protein 2
  ENST ID: ENST00000524781
  CDS Start-End: 1-69
gatagcaaagatgatgagagggttcctgctttgaatttattaatctgcttggttagcaggtatagttaatccttggcttctttattatttatcagtgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactatgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcactacaaccttcacctcctgggttcaagcaattctcccccctcagcctcccaagtagctgggcttacaggcacctgcc

SEQ ID NO: 136800 - DNA, 3748 bp, Homo sapiens
  Payload ID: 6785
  Gene Symbol: GEMIN4
  Gene Name: gem (nuclear organelle) associated protein 4
  Uniprot ID: P57678
  ENST ID: ENST00000319004
  CDS Start-End: 120-3296
aggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgacagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctggcccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagcgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcactttgtctcttctaagtcggcctcagcaatagcccaggattaaatatgctctgaaattgggtttagtgtcttcaagatcaaatccagccaggaggaacatgttcataactggacttttccatcctagattttggcaaataagcccaaagttgaaaccatgtgagtggaaaaagcattacatggtacgtataacccccttcaaga

SEQ ID NO: 136801 - DNA, 1182 bp, Homo sapiens
  Payload ID: 6785
  Gene Symbol: GEMIN4
  Gene Name: gem (nuclear organelle) associated protein 4
  ENST ID: ENST00000437269
  CDS Start-End: 33-587
gttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgacagccagacttggtgttgaggctgctggaaacagtgatagacgtcagcacagctgacagagccat

SEQ ID NO: 136802 - DNA, 673 bp, Homo sapiens
  Payload ID: 6785
  Gene Symbol: GEMIN4
  Gene Name: gem (nuclear organelle) associated protein 4
  ENST ID: ENST00000574958
  CDS Start-End: 463-673
gcgcgggcccggaccgaaacgtcccccgcgtcggggcgggtctaggggtcccggggtggccttggcggggggtggtccgggtcccgccgcgcgttgggccgcgtcttgccgcctccggccccctgcgcttgaaaacacggagcagacgtgaagttagagcccttggaagcgcccggggctcgcgcacgtgctttgggaaacgggctccctccgagcacccctgggcgccccgacggcctcatttcctgaacggcagctgcgttcttgagcaagtgtcttaacgctccaagtgtcttacgctcatgacgtttcctcatcgacagagcggggagaatggaagtgtgtctccccactgagttttgggcgactttgcattgagatcgccgagagctagggccatgagtaccttgtttttgactggaaggagctgtggggtggaccgtttccctgaaagctagaagaatgtttgaagcctgttcccaaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaaga

SEQ ID NO: 136803 - DNA, 4729 bp, Homo sapiens
  Payload ID: 6785
  Gene Symbol: GEMIN4
  Gene Name: gem (nuclear organelle) associated protein 4
  ENST ID: ENST00000576778
  CDS Start-End: 1343-4486
tggccgtgtgattgctctgtgcccattaccctgtggccgtgtgactgctgctgtgcccattaccctgtggccgtgtgattgctgctgtgcccattaccctgtggccgtgtgattgctctgtgcccattatcctgtggccgtgtgattgctctgtgcccattaccctgtggccgtgtgattgctctgtgcccattaccctgtggccgtgtgattgctctgtgcccattatcctgtggccgtgtgattgctctgtgcccattatcctgtggccgtgtgattgctctgtgcccattatcctgtggccgtgtgattgctctgtgcccattaccctgtggccgtgtgattgctgctgtgcccattaccctgtggccgtgtgattgctctgtgcccattatcctgtggccgtgtgattgctctgtgcccattatcctgtggctgtgtgattgctctgtgcccattatcctgtagccgtgtgattgcttctgtgcccattaccctgtggctgtgtgattgctgctgtgcccattatcctgtggctgtgtgattgctgctgtgcccattaccctgtggctgtgtgattgctctgtgcccattaccctgtggctgtgtgattgctctgtgcccattatcctgtggccgtgtgattgctgctgtgcctgttaccctgtggctgtgtgattgctctgtgcccattaccctgtggctatgctcccttcatctgtcatgagaagctcagctgtcatgtcctgtggtacatgctcagtggcccctgtagtttgtactgtcctcctatttctaaacccctctccccacatcctctgctggcccagcctttgctggagggtctcgcctcagcagcccagctttttcttttcacacacttttcctgaaggatctcattcaccgtcttggttccggtgatcccctctgggcagatacctctcagaatcacatttcccagcttacttccctcctgaacttccacctggcatttccgttgctggaggacatctgtaccttgatggccaaagctgaactcatctttcctcacacctgctctgattctcctccattccctgtatgtgatgtcacctggtggcctcccagttcccaggctggagagctcggaagccattctggattcctcggccaagtccttctgactccagctgtgcagtggctcttgtagtcatcccttctccccgtccgctgatgtcctttaaaacccttgtcatctcaaaccatgacagcctactaacagcagtggccatctggaaacattttcactatactgtcttatttggcttgtctgtgtgcaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgacagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctggcccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagcgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgca

SEQ ID NO: 136804 - DNA, 1015 bp, Homo sapiens
  Payload ID: 6785
  Gene Symbol: GEMIN4
  Gene Name: gem (nuclear organelle) associated protein 4
  ENST ID: ENST00000573482
  CDS Start-End: 128-1015
ggggagggggcgttagccccgcgcagccgccggcgtcgccgccatggacctagagctagggccatgagtaccttgtttttgactggaaggagctgtggggtggaccgtttccctgaaagctagaagaatgtttgaagcctgttcccaaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaag

SEQ ID NO: 136805 - DNA, 1048 bp, Homo sapiens
  Payload ID: 6785
  Gene Symbol: GEMIN4
  Gene Name: gem (nuclear organelle) associated protein 4
  ENST ID: ENST00000570364
  CDS Start-End: 234-1048
tgtcaagcacagattgcaagctcggggtccagcgtaaaccccaccatgtttgggctcacacggcgcattttctggggaggaccagccgtcaaaaagcgtctaggatccggaacgctgctgtctggagggggcggcgcggcaggagcgcgttgagggactagctagggccatgagtaccttgtttttgactggaaggagctgtggggtggaccgtttccctgaaagctagaagaatgtttgaagcctgttcccaaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaa

SEQ ID NO: 136806 - DNA, 633 bp, Homo sapiens
  Payload ID: 6785
  Gene Symbol: GEMIN4
  Gene Name: gem (nuclear organelle) associated protein 4
  ENST ID: ENST00000576383
  CDS Start-End: 65-633
atcatcacggaaagcttggtctccctcaaaacatgaaccgggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaa

SEQ ID NO: 136807 - DNA, 5397 bp, Homo sapiens
  Payload ID: 6786
  Gene Symbol: GEMIN5
  Gene Name: gem (nuclear organelle) associated protein 5
  Uniprot ID: Q8TEQ6
  ENST ID: ENST00000285873
  CDS Start-End: 77-4603
cccgctccctacctaaggcgtgaggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctattactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatactttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcgaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgacggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcgaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgattcaaatgtgtgttttcccttcagttttataacaaatggattgatggcagtcaaatagctcaggaataaattactgtttcaatggttcttaaactttcttggatcataggatccttttgagaatcagattaaagccaaagatactctttggag

SEQ ID NO: 136808 - DNA, 3728 bp, Homo sapiens
  Payload ID: 6787
  Gene Symbol: GEMIN6
  Gene Name: gem (nuclear organelle) associated protein 6
  Uniprot ID: Q8WXD5
  ENST ID: ENST00000281950
  CDS Start-End: 117-620
ggcgcaaagcatgctggtctcaggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgtacatgactgtgtgtgtgtatgtgtgtgtgtgtataattctttgttgttttggtaaaatcagaggagtgggttataagtgctaatttccttgggaaattaatgaactagggcaagtatagcatcccatgcataaaattagcacagggacatcagaattgtatgggtcttcttttttctttttttcttttttttttgagatggagtctcgctctgttgccaggtttgagtgcagtggcgcaatctcagctcagtgcaacctccgcctcccaggttcaaccgattcccctgcctcagcctctcgagtagctgggactacaggtgcacgccaccactcccagctaattttttgtattttagtagagatggggtttcacctgtatgggtcttttcttgtgatggggttacacccccatttttgttaggcaagaaaagcatttggaaaaaaatgtaacatgttagattcaatataaaatattatggtaagatcatggtcttgttaagtctcttcactaactgtatgtgtctgtttttaaaagatgtgtcttggtggggcgcggtggctcacgcctgtaatcccagcactttgggaggccgaggcaggtggatcatgaggtcaggagatcgagaccatcctggctaacacggtgaaaccccttctctactaaaaatacaaaaaaaattagccgggcgtggtggcaggtgcctgtagtcccagctactcaggaggctgaggcaggagaatggcatgaacccgggaggcagagcttgcagtgagccgagatcgcgccactgcactctagcctgggtgacagagcgagactccgtctcaaaaaaaaaaaaaaaaattattggaacacagcattacctattgaattacagttttctggtttttttgtggagtttttgttttggtttttgagatggagtttcactcttgttccccaggctggagtgtaatagtgcaatctcggcttaccacaacctctgcctcccaggttcaagcaattctcctgcctcagcctcctgagtagctggtattacaggcatgcaccatcacgccccactaattttgtatttttttagtagagacggggtttttccatgttggtcaggctggtctcaaactcccgacctcaggtgatccgcccgcctcggcctcccaaagttctgggattacaggtgtgagccaccgtgcccggctgttttttgtgggttttttgtttgtttgtttgtttttgagacagagtcttgctctgtcactcaggctggagtgcagtggcacaatctcggctcactgcaacctctgcctcctgagttcaagccattctcctgcctcagccccctcagtagctgggattaccaggcacatagcaccatgcccagctaatgtttgtatttttagtagagacagggtttcaccatgttgaccaggctggtcttgaactcctgacctcatgatctgcctgccgtggcctcccaaagtgctgggattataggcatgagagcctccgtgcctggctttttttttttttttttttttttaaaagagggtcttgatatgttgcccaggcttgtcttcaactcctgggttcaagtgatccttccaccttggcctcccaaagtgctgggaatataggtgtgagctgccatgtccagctgtaagaaatattttaaaatatttaagcttcagggcctttgaatacaggccctgataacatagctattttcctgcatagttgtctaataacaagatggtatagcccagtgcttcttgcactttagcaagcatcagaatcagcaaatatttaggtttcagggcctttgaatacagtctgataacacagctattttcctgcatagttgtctaataacaagatggtatagtccagtgcttcctgcatgttggcaagcatcagaatcagctgcagggcttttcaaaacagattgctggaccctcctcccaacagattctgattcagtagttctagttgggacccaggaatttgcatttccaacagactcccagataatgatgttaccgttcccagaccacacttgcagaagcagttcagaaacttcaggggaacagaaagttcctccctcacggcttcaaagttccatgatcctgaaagcaaaatttagcacacatcacctttctcctagtggctaagactctcctgttcaaaccctggatgtcttcagaaagcaaatagaaggggaatatgaacagactgaagtcagcaaggaaatgactgacaagatgagggaggcctttgaaaaggaagaagccagctgggcgcggtggctcacgcctgtaatcccagcactttgggaggcctaggcgggccgatcacttgaggccaggatttgtgaccaacctgggcaacatggtgaaaccctgtctctactaaaaaaaaaaaaaatagctgggtgtggtggtgagcgcctataatctcagctactcaggaggctgaggcactcgcttgaatctgggaggtggaggttgcagtgagccgagattgtacgcattccagcttgggcagcagaacgagactctgtctcaaaaaaaaaaaaaaagccacgtaggaaattatccacagcatcaattggacttgatcttggctcagggaccaggcccggtgccttgatattggtagatttatttgccatcagactaatgagctggggacattgactgtttcctggcaactgagtcctctgattgtgtaaacaatttgcctgcaaacaaaacctgagtgcttgaaagggtaagtgatcctgatctgccatagaaaccttcatgcttagggagtttccctagctaattcctcagctaagattctccccaggagtttcactcacctgtttccagtgcctcctttgggctgtcagcatctgtgattccacattccccagagggagattcctccccaaagctggttgtatttactgccagtcctgggctgtagccagggcagtctttgaacacattatcaagaatactttttaaaataaaagtctgtttcgacttc

SEQ ID NO: 136809 - DNA, 834 bp, Homo sapiens
  Payload ID: 6787
  Gene Symbol: GEMIN6
  Gene Name: gem (nuclear organelle) associated protein 6
  ENST ID: ENST00000409566
  CDS Start-End: 92-427
ggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgcaggttcaagcgattctcctgccttagcctcccgagtagctgggactacaggcatttgccaccacgtctggctaatttttgtattttttgtggagacggggcttcgccatgttgcccagtattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcata

SEQ ID NO: 136810 - DNA, 1210 bp, Homo sapiens
  Payload ID: 6787
  Gene Symbol: GEMIN6
  Gene Name: gem (nuclear organelle) associated protein 6
  ENST ID: ENST00000409011
  CDS Start-End: 566-775
aacgccacgatctctccagtaaacctgaggccttccccatgctgtcccgccccctcctctccccgttttctacaccctccttgtcttctttcccgtctccctaccctctgcctcctttcgtttttccccaggctagggaccctcagccttaacaatcttagtacggatgcattagaccggcctatgaaaggctgtacaatttaaccgctgatgttgcagccgtcgcgcccttctgctgggggacctggcctagtcagctactctgatctttggggctcatcagagcatgtaagtcttctcatgaatgtctcctcatgatggaaagaggctgcctcacctccaggccttatgtccaagccaggcaggctgaaggaagaatggtcccgcgactctcagacctccaagtaggactacaaaacagaggtttctgggggaaggaagtgacgatcggcgcaaagcatgctggtctcaggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgcagtattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaa

SEQ ID NO: 136811 - DNA, 1657 bp, Homo sapiens
  Payload ID: 6788
  Gene Symbol: GEMIN7
  Gene Name: gem (nuclear organelle) associated protein 7
  Uniprot ID: Q9H840
  ENST ID: ENST00000270257
  CDS Start-End: 248-643
cagtagccgcggacctcggtgagtacaaggtggtggggggtcgccagcaggttccctctccccggccccagctctggacgctcaccccagtgcaacgccctgagtgacggaaagaggtctggcggcttctctgttgacaactcagctggttccacaccctggcaattgtgaagagttggccaaatgtttgtccactgagctgatctcctctctggagcaccggggccaccaggagggagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctcttttctctccagccttgcagcgtggccgttcacatcacgcgcttcactaagcctcctatcactagtaacctttcagcgcattgtttaaaaagaaagcagtttctgtccctttctgtagttcctttaagttcaggatgtaagcgaagccttccattaagtaaaggtgagtgtcgtttcgtctcagtcgcg

SEQ ID NO: 136812 - DNA, 716 bp, Homo sapiens
  Payload ID: 6788
  Gene Symbol: GEMIN7
  Gene Name: gem (nuclear organelle) associated protein 7
  Uniprot ID: Q9H840
  ENST ID: ENST00000391951
  CDS Start-End: 118-513
cgcggacctcggtgagtacaaggtggtggggggtcgccagcaggttccctctccccggccccagctctggacgctcaccccagtgcaacgccctgagtgacggaaagagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattg

SEQ ID NO: 136813 - DNA, 576 bp, Homo sapiens
  Payload ID: 6788
  Gene Symbol: GEMIN7
  Gene Name: gem (nuclear organelle) associated protein 7
  Uniprot ID: Q9H840
  ENST ID: ENST00000591747
  CDS Start-End: 154-549
acaccagtagccgcggacctcggtctggcggcttctctgttgacaactcagctggttccacaccctggcaattgtgaagagttggccaaatgtttgtccactgagctgatctcctctctggagcaccggggccaccaggagggagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttga

SEQ ID NO: 136814 - DNA, 848 bp, Homo sapiens
  Payload ID: 6788
  Gene Symbol: GEMIN7
  Gene Name: gem (nuclear organelle) associated protein 7
  Uniprot ID: Q9H840
  ENST ID: ENST00000591607
  CDS Start-End: 94-489
cccaggctccgcggcttgcggcctgcccgggcctctgcagcgggggcgccggcggaagtggggacaccagtagccgcggacctcgccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaaga

SEQ ID NO: 136815 - DNA, 868 bp, Homo sapiens
  Payload ID: 6789
  Gene Symbol: GEMIN8
  Gene Name: gem (nuclear organelle) associated protein 8
  ENST ID: ENST00000332885
  CDS Start-End: 338-868
gagattcctaaatcattgcaggttaattgtgagaggggaccagtcccagaggctctcagctctgcagtgcttccgaatcactggacgactctttaagaattctgatccccgggcccccatcccggaccaatgaaatcagaatctctaatagtggggccctggcatcggtagtttttaaagctgcccaggtgattctggggtgccgagaaccaccgtgttaagctccaccagcccattggagaaaagttactgttcagtccctgaaggcttgtgccataaaagagtgggagacattcccagggagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgac

SEQ ID NO: 136816 - DNA, 1682 bp, Homo sapiens
  Payload ID: 6789
  Gene Symbol: GEMIN8
  Gene Name: gem (nuclear organelle) associated protein 8
  Uniprot ID: Q9NWZ8
  ENST ID: ENST00000380523
  CDS Start-End: 320-1048
agtcgccccggcaacagccgcctccctcgcgtcccccactccccctctgtctctccaaggaaaactaggcccctgcgcggccaacgcccaggatccgcaagctgcgcgcccacgagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatactatactggttttttatgttgttggtaacagttcaattcattaacgttcttgcctagagatactgcctggtgttttgcttttttatcttttcttgtctttaacctgtctgaactacacaaatgcctttaaaaaaccagatatcctctctgactctagctccattagcccccactaaaaatgagccaagtgtgtagtgagacaaataccactacctgtagtggagagggatgcatgttctataaagggccagagagtgaatatctttggcactgcaagccacacggtcagtgttgtgactactcaaccctccctttgtagtgtgaaagcagctgtagacagtaagtaaacaaatgggtgtggctgtgttctaataaaactttatttataaaaacag

SEQ ID NO: 136817 - DNA, 1119 bp, Homo sapiens
  Payload ID: 6789
  Gene Symbol: GEMIN8
  Gene Name: gem (nuclear organelle) associated protein 8
  Uniprot ID: Q9NWZ8
  ENST ID: ENST00000398355
  CDS Start-End: 151-879
cagtcgccccggcaacagccgcctccctcgcgtcccccactccccctctgtctctccaaggaaaactaggcccctgcgcggccaacgcccaggatccgcaagctgcgcgcccacgagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatac

SEQ ID NO: 136818 - DNA, 3538 bp, Homo sapiens
  Payload ID: 6790
  Gene Symbol: GMIP
  Gene Name: GEM interacting protein
  Uniprot ID: Q9P107
  ENST ID: ENST00000203556
  CDS Start-End: 139-3051
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctata

SEQ ID NO: 136819 - DNA, 910 bp, Homo sapiens
  Payload ID: 6790
  Gene Symbol: GMIP
  Gene Name: GEM interacting protein
  ENST ID: ENST00000593186
  CDS Start-End: 1-910
ggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggactt

SEQ ID NO: 136820 - DNA, 747 bp, Homo sapiens
  Payload ID: 6790
  Gene Symbol: GMIP
  Gene Name: GEM interacting protein
  ENST ID: ENST00000591047
  CDS Start-End: 73-183
cggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagca

SEQ ID NO: 136821 - DNA, 2987 bp, Homo sapiens
  Payload ID: 6790
  Gene Symbol: GMIP
  Gene Name: GEM interacting protein
  Uniprot ID: Q9P107
  ENST ID: ENST00000587238
  CDS Start-End: 33-2867
cggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccagacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtcca

SEQ ID NO: 136822 - DNA, 594 bp, Homo sapiens
  Payload ID: 6790
  Gene Symbol: GMIP
  Gene Name: GEM interacting protein
  ENST ID: ENST00000587205
  CDS Start-End: 312-594
ggctcggccccgccggcgcgcgaccccatccccatcccggtccctgcagagcgatccccgggcccagatatggacgcagcagagccggggtgccacgactgctgagggagagggcaacgcggtaggatccccacagggcccctctgtagccctggggagtcggcagtgctggtctaggccccttaggagagggggcaggggggcagcagtagaaatgactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcg

SEQ ID NO: 136823 - DNA, 869 bp, Homo sapiens
  Payload ID: 6790
  Gene Symbol: GMIP
  Gene Name: GEM interacting protein
  ENST ID: ENST00000588171
  CDS Start-End: 92-202
ggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcc

SEQ ID NO: 136824 - DNA, 513 bp, Homo sapiens
  Payload ID: 6791
  Gene Symbol: GMNC
  Gene Name: geminin coiled-coil domain containing
  ENST ID: ENST00000456552
  CDS Start-End: 62-253
cactggttttactgaaaaattgagtgggctcagtttctgcagcgctttcttccactgcaagatgaacaccattctgccttgccaagaccagtactttgtaggaggccagagctataattgcccgtattccactacaacgtcagaatctagtgttgacgtttccacggagacttgggtctctttctgggctgctggtctcctggacaacagagagctccaacaagcaccacaggcacaggtatcaacaatataaccagagaaggacaagagtctaaactgtactagatgaagaaaagaaagtaaaagtagacctgaatcattcagtgactcaaattttcctcttccggacttgtgctcatgggaagaggctcagctttcctctcagctctacagaaataagcagctgcaagataccctggtgcagaaggaagaagaactcgccaggttacacgaagagaataatcacctcagacaatacctgaattctgctttggttaaatgtcttgaagaaaa

SEQ ID NO: 136825 - DNA, 3422 bp, Homo sapiens
  Payload ID: 6791
  Gene Symbol: GMNC
  Gene Name: geminin coiled-coil domain containing
  Uniprot ID: A6NCL1
  ENST ID: ENST00000442080
  CDS Start-End: 1-1005
atgaacaccattctgccttgccaagaccagtactttgtaggaggccagagctataattgcccgtattccactacaacgtcagaatctagtgttgacgtttccacggagacttgggtctctttctgggctgctggtctcctggacaacagagagctccaacaagcaccacaggcacaggaatcattcagtgactcaaattttcctcttccggacttgtgctcatgggaagaggctcagctttcctctcagctctacagaaataagcagctgcaagataccctggtgcagaaggaagaagaactcgccaggttacacgaagagaataatcacctcagacaatacctgaattctgctttggttaaatgtcttgaagaaaaggccaagaaattgctctcatctgatgagttctccaaagcatatggaaaattcaggaaggggaagagaaaatccaaagagcaaagatactctcctgctgagattccccatcccaaaaatgccaaaagaaacctctctagtgaatttgctaactgtgaagaacaagctgggccccctgtggatccctgggtccttcaaacacttgggttaaaagaccttgacactatcgatgacacctcatcagctaactacagtgccctcgcatctcatcccagaagagtcgccagcacattttcccagtttccggatgatgcagttgattataaaaatatccccagagaggatatgccaattgactatagaggtgacagaacaacccccttgcacagcactgccactcatggagaagatttccacatcctttctcaactttcaaatcccccagtggggctgaaaactcttccttactatactgctcatgtgtcacccaacaagacagagatggcattttccacatccctgagccctcattgtaatgtgaaaactcattccttccaccagggacaagcctttgtgcgtcgagatgaggagggaggctggaagtttacctgggtccctaagcagtcttagtgacccctcttttatcacaaagcactgccacgaactctgtttacaaagacctctcttgcacttgaatttgactatgtggaacacagaagctgttgcttagactgtctcctgccactttaaatgtcactctcaattacccacttaaatctgcagggaatggcttccaagaatccataatgaaacgtgtccgcgcttcttttacctaaatttgacttgtttacacaccaatacctgctattgacatcctctctttgccctatacttgataaggtattttccactcacttctatattcctttaagacctagatacatttttccaattttaaccagtttaacagattttcctcttttaagtagttgaaatattcacagcccttttacttttctccctttgtcatttctgaaaactgtctttagaatgagccctatttttgcttcaagtacttgctactgcatgttcaaatagctgagggtggggttgaaacaagtgtctttgcccatcaccactactcctgaagacataatgtggatgtgtgtagcattatgttcatggcagttcaaaaagttcagtgccccatagtggcattgacaaagcctcttaaaacaactgtaactccactaataatcaatatcacagataaactttaaaattacaaagaatttaaattatttttaaatgcctcatgatgtatcagcttctatatgtacccagcatcatttctttaaccaacatgactccaagaagaacattttgagggactgtggtaacaaaactagtcatcatctgcaactacccagatgctgacaaactcctattgctgaaaatagactaacctagctcagccattgtctcattcattcattcattcgcgtattcattttttcattgatcagtccacccaagaaatctgtagaatacctaatgcctactttgtaccaggcactatgctatgtgatggtgataaaatacaagcaatttagacactgtggccaccatcatgagacttagacctactcatctgctatgactttgcgaaaacgacttcccttttgtgaaggttcagtttcccaactgtagaatacagaagttggactagataattactaatattctatgaattgaggctgggtcctatcagatttactccaacatggcagtttcaggtcactgaagaaactaaagagaagtctttagataggcactgcaagtattaggtagggtaaactttatgtacaattaataaaattcaaaaacataagtcatttgaagttaacattagaaatcattgctctgatcacagtactctttttctagagcccattttgcagttaactcggcgtaactgtgtaagaataatttgcctctaaaaatagatacatattaatttttaaataagtgcggatagattgcatataaatattgctatcaaggacttcatatttctaaatttgaaacaatatattttcagtgcttgtgctagttttcttctttcccatctctcaagacccctatcattcccagaataatttgcacatcctgcatgtgcacctatgttttttggacaaacttcaattaatgatgaaatctttcatgttgaaacctgttctcatttttctcttttccacatctcaataagtcatcttgcacaatcaatatctcgtaggtcaactgtgttggttaggattctttgtaacagagacatgcctttcattgttgtttctgtttggttgttgctttattttggtgatgtaagcaaagggtctgttttataaagttttgttgccacccacttttaaaaataatttatgaagaaaatccaatatagtaattaatattactctctggagtactttaagaagtagaacacattccattttctaaaaaataaaataaaataaataactgtgccttttacattctggtatctgggcccctggtcggtgaaatttgtcgctttttagaataagagatttaaggattcgaattattgtactttatgacactaggaattgagaaagtaatataactaattttgaaagtctaataatcaagctgtaaaaggaaatgtatgagttaacaaatatttattttgcattctttgtgtgccttatcatgtgttaagtaccatgagggtacacccaggcttagcacaatgcatttggtatacaaaaccatgtaaaatgtcatagcttttgatagcttttaaatgaaacttaattttggcccagtttaaagatattaccgaacatttgggataaaatgtgatggtttcctggcttctatcatggacgatgttatggaagacaattaccacgtttttgaaatcatgtctataaatatttaatatccatttaaattatgtatagaaaattattttgttcatgttttagaaattaaacatttctttcacctga

SEQ ID NO: 136826 - DNA, 1262 bp, Homo sapiens
  Payload ID: 6792
  Gene Symbol: GMNN
  Gene Name: geminin, DNA replication inhibitor
  Uniprot ID: O75496
  ENST ID: ENST00000230056
  CDS Start-End: 333-962
tcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaa

SEQ ID NO: 136827 - DNA, 1133 bp, Homo sapiens
  Payload ID: 6792
  Gene Symbol: GMNN
  Gene Name: geminin, DNA replication inhibitor
  Uniprot ID: O75496
  ENST ID: ENST00000356509
  CDS Start-End: 208-837
gtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtag

SEQ ID NO: 136828 - DNA, 653 bp, Homo sapiens
  Payload ID: 6792
  Gene Symbol: GMNN
  Gene Name: geminin, DNA replication inhibitor
  ENST ID: ENST00000378054
  CDS Start-End: 116-653
gacgcgcggggccacactgcccgccccctagcctggcgctgggcctccgggacaagttggctgggtccgggcttggggactgcaacgcggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaa

SEQ ID NO: 136829 - DNA, 688 bp, Homo sapiens
  Payload ID: 6792
  Gene Symbol: GMNN
  Gene Name: geminin, DNA replication inhibitor
  ENST ID: ENST00000378059
  CDS Start-End: 382-688
gatgctgctctttaggatggacctgggcataccctagtatctgtttattttgctttttctggtgactatttaatccaggacaatatgtttagaaattttaaaccagttttagaaattggtttaaaatacattaatttcattttttcagctataattattatgtgtgtatatatgtaaaatatagatatcaagagtcattaactttagtcaccttagtcattgacagggctgagtttggattaagagagaaaaaataatagttctactgtacaatagtataatttttatgattgtaagtattttaaacctagactccaccttcgggggtgcaaaccatattgttttttaattactagtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtgg

SEQ ID NO: 136830 - DNA, 580 bp, Homo sapiens
  Payload ID: 6792
  Gene Symbol: GMNN
  Gene Name: geminin, DNA replication inhibitor
  ENST ID: ENST00000476555
  CDS Start-End: 384-580
agttggctgggtccgggcttggggactgcaacgcgggtaagggactcagcctgggcttgccagctgtggggatgaggcgaagcatccatcctcttggcagttaagtggctggtcctgatctgagggatctgcaaatttggctcatggaaagaggtggctgaattctgcgtctcccattaaacggatactggcgttgttgatacgggtttcgcatggaccctgtcctgtgccagggtttttaatctagctattaaaggaactggagaataacaagtaagggttgcaaggtcgctgacaggcgtgggaaacttgtgaaggattagaatgctaagtggctttcagcttttttcacactaagtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctgg

SEQ ID NO: 136831 - DNA, 1039 bp, Homo sapiens
  Payload ID: 6792
  Gene Symbol: GMNN
  Gene Name: geminin, DNA replication inhibitor
  Uniprot ID: O75496
  ENST ID: ENST00000620958
  CDS Start-End: 116-745
gacgcgcggggccacactgcccgccccctagcctggcgctgggcctccgggacaagttggctgggtccgggcttggggactgcaacgcggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgt

SEQ ID NO: 136832 - DNA, 9854 bp, Homo sapiens
  Payload ID: 6793
  Gene Symbol: GEN1
  Gene Name: GEN1 Holliday junction 5' flap endonuclease
  Uniprot ID: Q17RS7
  ENST ID: ENST00000317402
  CDS Start-End: 126-2852
gcagttgcggggtttcgcgccgccggagtctgagaggccggaagtgccccttagcgggtgggggaagctggtaggcacgggcggctccgcagtgaccggactcgggggagcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggacccacatgttgactgttacacaatgtcatctatcaagagtaaactaggtttggatagagatgctctggttggattagcaatacttcttggctgtgattatctcccaaagggagtccctggagttggaaaagagcaagcattaaaacttatacagattttgaaagggcaaagtttacttcagaggtttaatcggtggaatgaaacatcttgtaactctagtccacaactgctagtcactaaaaaactggctcattgttccgtatgttcccatccaggttcacctaaggatcatgaacgtaatggatgcagattatgtaaaagtgataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggtcttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaggactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaatcaaatcttttaagttgctgcttacgtatttgctcatcacttcattgtcttgttgaggatgccttgcttccctttgaaatactctgccaaagatctgcctccagctgctaggatcctgtaattggtttctttctgatggctccatgctaaggccctgctctggcctaactgctttgggctttgtgtaatcaatcttaagtccttggcggtttttcttttagatttttttccatataaaatctctatctggccacacatggtggccgtgcctgtaatcccagcacgctgggaggctgaggcgggtggattgcttgaggccaggagttcaagaccagcctggccaacatggtgaaaccccatctctactaaaaatacaaaaatcagtggggcctggtggcgtgcacctgtaatcccagctactcgggaagctgaggcaggagaatcgcttgaacctgggaggcagaggttgcagtgagctgagatagtgccactgcacttcactccaggatgggcgaaaaagtgtctaaaaaaaattaaaatttaaattaaaaaaaaatatacaatctccgtcttctagattttataatgaggactctactttttccttttgggtagcatggcttgagccatcttgtcaggcatacctagcttcagattcttttctgctaacagattttctctgtgaccctggagacattttctaacttttctgagactcatttattcaaatgtttatgtgacaggcattgtgctgggccctggagatacagtgatcaatggcatcctataaggttttgatatctgtgaagtcactgccaccattgacacattctagggactcagtaaattgtagctgtgtccgataccatcatttggaaagagcactatcagattttggattcaaactgaatgcagccaagcactgccttttggtaaaaatgtggacacagtaacactagtagggggcagtgtgagggtgggagatgtgttttcagaagaaggaaactctagattagcatcacacaagggatcctaacgtggcatttgagctactggaaaaaaattgtgcttgcttaaatataatgtggtaactaatattcatctaatcacctaccacatttttggagcacccactttgagcaaggttcttaggcttttctatgtacaacagccagctggaggcccagtgagtttaaaatttttccaggtcacccaactagaaaaagttaaagctgggactagaactcagatctcctaattcatgagtgaaaacaattctctgtatttatgtttccatacatcattcagttcttgactcaaatatcacctcagagagtcctaatctttttatctcctgacattataaatgttgagttcagggttttttttttcattgtttcccaaactagaatgcagacttgatgagggcagggactaagtcctttctgttcacagaattctagaacagtgtttgacacagtaactactagatgcatgaatgacaattctccacaacgccccacccatggagcctgtaccagcagtggctgcacttaaccttgcggaatctggccttagtacttcagcatggctcacaaggctgaggcagcctggccccaacttgtctcttcagcttcatgcattcatagtcatgaaccttggctctagccacctaagaccatttgttattccctgcacggatgtctctgcctgaaatgcttgctgcttccttattggctagataaacctcatctattaaggaccagctcacatgtcataactttataatcccaagcagaattatttgctctatacgtgtccccaaagaaattacccatacattcatcagagtatttatcacattcattcattcgttccacaaatattagctgatgcctgccgtgtaggaggcacaatattccttacttaaaaatgcctctatctctccctcagataagactaagatctctgagcacaggaatcaagtcttatttctgttcacttcccccagatgcctacacagggtttgactcttctgcctcaccaactcttacccatcgagattcagtgtaaacgtggtcttctctaagaaagtcttctgttgcttctctggatcgctgctagtccccatagacttctaaaatattatctgtctatagttttgtgttgggttacattttttgtttcccacaccagactatgaacatcctcagggcagagaaactatattgtacttctgaatttatagcacccggcagagggattggcacagaaagtgtccagtgaggccgggtgtgggggctcacatcagcagtttgggaggccgagatgggcagattgcctgaggtcaggagttcgagaccaacctggccaacatggtgaaatcccatctctacaaaaaatacaaaaattagccgggtgtggtgatgggtacctgtaatcccacctacttgggaggctgagacaagagaatcacttgaacccgggaggcggaggttgcagtgagctgagaccgtgccattgcactctagcctgggcaagaagagcgaaactccatctaaacaaaagaaaaaagaaagtgttcagtgaatgggtgctgattgactgatggtgatttcagtcagggtcttagttctaaatttctctgtggagagagaccaaatctaaccgggtggattagcttgatacctagtcgcctttagccacttcaagacgccctgccaagatgcttgctttctgaaggtgaagagtctaaatcaactgctgttcctgttctgctggtagcacttagggtaaaacagcttaaatagtattactgaaggcagcctcctttcatctatatattaacgtggcaatgtttatcaccttcttaaccaagcaaagcttttatcaggctcagctaacagcttgcattagcctctttcaggaacttgccacattgcctataaactgacatgctgcagagtcagccccagcaatagtccaaaacagtgggactctttttgatgatttcaaaatggatagtttagttagccccaggccagataaattcactaagttgcctgtttggcaatggagggcagagttatcagcaaagtaggctgacccttctgtgggcagaatgaatattttgctaatgtttagaagaattccttttgtaagcatcaaagaagaactttaataaggattaagtgtctgagcttccttagcattattctattccaagacccaaaaaggaaaataacctccccaaatggtaaaaactgcttgtatatttagaattctctgatcaaagacctaatgaaaagattctatagtgtttgcgtcatcataagttaaatcttcatctaccacccaactgatacctgcctttctgtgagtgaaatcagaaacggctgttctttaataaatgctttcaatctgaaagtcagaaagtgatttatgaaacacccaggtgaggggagactacaagtccctttgccttttagttttcaagcaatactggttgcagtaactgctctgatgtaattattgctaacatttacgtttttattaaactgaaaatgctaactgtgaa

SEQ ID NO: 136833 - DNA, 6367 bp, Homo sapiens
  Payload ID: 6793
  Gene Symbol: GEN1
  Gene Name: GEN1 Holliday junction 5' flap endonuclease
  Uniprot ID: Q17RS7
  ENST ID: ENST00000381254
  CDS Start-End: 215-2941
gaaacgcttcctggtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggacccacatgttgactgttacacaatgtcatctatcaagagtaaactaggtttggatagagatgctctggttggattagcaatacttcttggctgtgattatctcccaaagggagtccctggagttggaaaagagcaagcattaaaacttatacagattttgaaagggcaaagtttacttcagaggtttaatcggtggaatgaaacatcttgtaactctagtccacaactgctagtcactaaaaaactggctcattgttccgtatgttcccatccaggttcacctaaggatcatgaacgtaatggatgcagattatgtaaaagtgataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggtcttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaggactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaat

SEQ ID NO: 136834 - DNA, 498 bp, Homo sapiens
  Payload ID: 6793
  Gene Symbol: GEN1
  Gene Name: GEN1 Holliday junction 5' flap endonuclease
  ENST ID: ENST00000532257
  CDS Start-End: 219-498
gtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggtgtgtttcacataacagcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggt

SEQ ID NO: 136835 - DNA, 593 bp, Homo sapiens
  Payload ID: 6793
  Gene Symbol: GEN1
  Gene Name: GEN1 Holliday junction 5' flap endonuclease
  ENST ID: ENST00000524465
  CDS Start-End: 215-593
gaaacgcttcctggtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcc

SEQ ID NO: 136836 - DNA, 457 bp, Homo sapiens
  Payload ID: 6793
  Gene Symbol: GEN1
  Gene Name: GEN1 Holliday junction 5' flap endonuclease
  ENST ID: ENST00000534451
  CDS Start-End: 1-390
catgaacgtaatggatgcagattatgtaaaagtgataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcggtaatgtaaagaactgtatggtgaaggtggtgtttttacttgagtattttataattaaaatattcctaata

SEQ ID NO: 136837 - DNA, 1677 bp, Homo sapiens
  Payload ID: 6794
  Gene Symbol: GTF2A1
  Gene Name: general transcription factor IIA, 1, 19/37kDa
  ENST ID: ENST00000298173
  CDS Start-End: 435-614
ggcggcggcggcggcggcggtggtggctcgcgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttatagtttttttttttttggttttgtttttatcttgttttcttggggttgccccctcttgtttgtgttgtgtgtggaaatggcgaactcggcaaatacaaacaccgtgcctaaattatacagatctgtgattgaagatgtcattaatgatgtgagagacatctttctggatgatggagtggatgaacaagtactgatggaactaaaaactatcctgaataagacagttgctgcccagaagatgttcatactttggtagaaatggtagactttgtgtgttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaa

SEQ ID NO: 136838 - DNA, 1199 bp, Homo sapiens
  Payload ID: 6794
  Gene Symbol: GTF2A1
  Gene Name: general transcription factor IIA, 1, 19/37kDa
  Uniprot ID: P52655
  ENST ID: ENST00000434192
  CDS Start-End: 172-1185
gctttgcaagttcttcaccgcaaagaactgccgcagacttccgcctgggtgccaaccacgtgatcacgcgagcgttggagaggccctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttt

SEQ ID NO: 136839 - DNA, 6306 bp, Homo sapiens
  Payload ID: 6794
  Gene Symbol: GTF2A1
  Gene Name: general transcription factor IIA, 1, 19/37kDa
  Uniprot ID: P52655
  ENST ID: ENST00000553612
  CDS Start-End: 405-1535
cgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttatagtttttttttttttggttttgtttttatcttgttttcttggggttgccccctcttgtttgtgttgtgtgtggaaatggcgaactcggcaaatacaaacaccgtgcctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttactggcaagccatggaactgtagcacctagggtttttgggtgggagggttggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaattttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagcaaa

SEQ ID NO: 136840 - DNA, 1639 bp, Homo sapiens
  Payload ID: 6795
  Gene Symbol: GTF2A1L
  Gene Name: general transcription factor IIA, 1-like
  Uniprot ID: Q9UNN4
  ENST ID: ENST00000403751
  CDS Start-End: 38-1474
gcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacac

SEQ ID NO: 136841 - DNA, 1575 bp, Homo sapiens
  Payload ID: 6795
  Gene Symbol: GTF2A1L
  Gene Name: general transcription factor IIA, 1-like
  Uniprot ID: Q9UNN4
  ENST ID: ENST00000430487
  CDS Start-End: 78-1412
aaaacgtgcccagtgtttccctccgagggcactgcgtgccgcgcaggcgcaaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattac

SEQ ID NO: 136842 - DNA, 473 bp, Homo sapiens
  Payload ID: 6795
  Gene Symbol: GTF2A1L
  Gene Name: general transcription factor IIA, 1-like
  ENST ID: ENST00000423675
  CDS Start-End: 28-195
aaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacaggttggataccattacatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatgg

SEQ ID NO: 136843 - DNA, 1082 bp, Homo sapiens
  Payload ID: 6795
  Gene Symbol: GTF2A1L
  Gene Name: general transcription factor IIA, 1-like
  ENST ID: ENST00000437125
  CDS Start-End: 78-1082
aaaacgtgcccagtgtttccctccgagggcactgcgtgccgcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacaggttggataccattagtaaatgagtactcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaag

SEQ ID NO: 136844 - DNA, 571 bp, Homo sapiens
  Payload ID: 6795
  Gene Symbol: GTF2A1L
  Gene Name: general transcription factor IIA, 1-like
  ENST ID: ENST00000448460
  CDS Start-End: 78-571
aaaacgtgcccagtgtttccctccgagggcactgcgtgccgcgcaggcgcaaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaat

SEQ ID NO: 136845 - DNA, 532 bp, Homo sapiens
  Payload ID: 6795
  Gene Symbol: GTF2A1L
  Gene Name: general transcription factor IIA, 1-like
  ENST ID: ENST00000508440
  CDS Start-End: 1-309
agcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataaggcattcccaagaaggacatcgtttaacacctaaactcatttaacaaaggatccgagaagaacagggacagtgtgggaagaaatcttcttgtgatggcatatttgcttcctatatttcttctggaatcatgttcgcttggcttcctgattaaaaacacagttttattgctctctgcactgccaaaccaataaatttacagaagagaaagctgtattccactgtaccccttgcagcatcaataaaactgacagccaaa

SEQ ID NO: 136846 - DNA, 1582 bp, Homo sapiens
  Payload ID: 6796
  Gene Symbol: GTF2A2
  Gene Name: general transcription factor IIA, 2, 12kDa
  Uniprot ID: P52657
  ENST ID: ENST00000396060
  CDS Start-End: 183-512
gagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcagttgtaactttacctgatgaaagcatcagcaggggcaaaaccaaactctggatggaattttttaagaaaatcccttgctttttaaaatacaaaaccaaagttaatcattggtataaaaaaacccaagtacaacttgattaggaaaagttagacaatcatagcaaaaacaaaaccaaaaaactttccttcttagaccaggtaacatgaggaagggggaaaaaaacccaaacaaaatagtccccccacatgacaggtgtcttcagcttgccatattgatccaaagttcatacattttatcatgtacaagatacattagacttacaataaagtctaattattagacttttatgtcagtggattgtgcttgcagaaatacagaagtaacatactgaccctaggtgaggagtttcttacatggttaactggattgacccaattggagtaaaagatttttgctgttacctcgatgctcctgcagttgttacctcagcatgccactgtagtccttgactctcacattaaaactaactttggctaggtactggtggctcacacctgtaagtaatcccagtactttaggaggctgagactggaggattacttgagtccaggagttggagaccagcctggccaatatagactgtccctacaaagaaaataaaattgtttcatcttccaa

SEQ ID NO: 136847 - DNA, 758 bp, Homo sapiens
  Payload ID: 6796
  Gene Symbol: GTF2A2
  Gene Name: general transcription factor IIA, 2, 12kDa
  Uniprot ID: P52657
  ENST ID: ENST00000396061
  CDS Start-End: 406-735
ggagaagtaggaacctcctgccgggctcgtggcggcttctgtccgctccgcggagggaagcgccttccccacaggtagtgggttagggagggcagggttagggagggaagcagggccgcgctccctgccgcccccccggagtcggagtgcgttggtggggtagtctctgagggcccttcgctcctgggatctgcccgttaccgaccgttgccggcaaggccccgcggccggcaccggagaagggcggcgaggcggcggtgatggtcgcgtcccgtggcgggaggctcgtcgttcacggggcgcccacagaacccacctaggggaggtcttcagcccaccaccgtattttcagccaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgactttttta

SEQ ID NO: 136848 - DNA, 970 bp, Homo sapiens
  Payload ID: 6796
  Gene Symbol: GTF2A2
  Gene Name: general transcription factor IIA, 2, 12kDa
  Uniprot ID: P52657
  ENST ID: ENST00000396063
  CDS Start-End: 378-707
gttctgcggtttctgcggcggctggagaggtggtcggagaagtaggaacctcctgccgggctcgtggcggcttctgtccgctccgcggagggaagcgccttccccacagcttgttgtttgaagtctgccttccaactttcttcgtgcgaactccgacaaaaggaacgaattttaaacttggtggtttaatcaaaaaatgctaggacgagttacttccgaatttgacttctaattttctgaactgcaaaacaagaagggaacaataaatttctgtggctgataccacatctaaaagattagaacacttaacaaggaatttttaaagaatgacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactc

SEQ ID NO: 136849 - DNA, 633 bp, Homo sapiens
  Payload ID: 6796
  Gene Symbol: GTF2A2
  Gene Name: general transcription factor IIA, 2, 12kDa
  ENST ID: ENST00000396064
  CDS Start-End: 165-371
agctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactctga

SEQ ID NO: 136850 - DNA, 408 bp, Homo sapiens
  Payload ID: 6796
  Gene Symbol: GTF2A2
  Gene Name: general transcription factor IIA, 2, 12kDa
  ENST ID: ENST00000484743
  CDS Start-End: 165-389
agctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttt

SEQ ID NO: 136851 - DNA, 382 bp, Homo sapiens
  Payload ID: 6796
  Gene Symbol: GTF2A2
  Gene Name: general transcription factor IIA, 2, 12kDa
  ENST ID: ENST00000559706
  CDS Start-End: 166-382
cagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtac

SEQ ID NO: 136852 - DNA, 1351 bp, Homo sapiens
  Payload ID: 6797
  Gene Symbol: GTF2B
  Gene Name: general transcription factor IIB
  Uniprot ID: Q00403
  ENST ID: ENST00000370500
  CDS Start-End: 120-1070
acgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaa

SEQ ID NO: 136853 - DNA, 783 bp, Homo sapiens
  Payload ID: 6797
  Gene Symbol: GTF2B
  Gene Name: general transcription factor IIB
  ENST ID: ENST00000418217
  CDS Start-End: 91-783
actcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcc

SEQ ID NO: 136854 - DNA, 770 bp, Homo sapiens
  Payload ID: 6797
  Gene Symbol: GTF2B
  Gene Name: general transcription factor IIB
  ENST ID: ENST00000448623
  CDS Start-End: 1-675
gcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccagaaattggagatattgctggtgttgctgatgttacaatcagacagtcctatagactgatctatcctcgagccccagatctgtttcctacagacttcaaatttgacaccccagtggacaaactac

SEQ ID NO: 136855 - DNA, 3012 bp, Homo sapiens
  Payload ID: 6798
  Gene Symbol: GTF2E1
  Gene Name: general transcription factor IIE, polypeptide 1, alpha 56kDa
  Uniprot ID: P29083
  ENST ID: ENST00000283875
  CDS Start-End: 94-1413
atttaagccggtagttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaagaagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagtttgacttttatgccagaaactttcccagcaaggtagggtgctgagaatcctacccttccttgctgtcactacagtattaatattttactgtattttcttttcttttttttttttttttggagatgaagtctcactcttgtaccccaggctggagtgcaatggcgtgatctcggctcactgcaacctctgcctcctgggttcaagcgattctcctgcctcagcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactga

SEQ ID NO: 136856 - DNA, 551 bp, Homo sapiens
  Payload ID: 6798
  Gene Symbol: GTF2E1
  Gene Name: general transcription factor IIE, polypeptide 1, alpha 56kDa
  ENST ID: ENST00000492959
  CDS Start-End: 186-551
agttgaagcgctgggggcagctgtagtgggagtgttccaggattcgccttgggatccagtatttaagaatattttgggctgctctccctccctcattttctacctttttaaggactggatggtctttccttgattatcagattcaatttttcaagtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgacc

SEQ ID NO: 136857 - DNA, 543 bp, Homo sapiens
  Payload ID: 6798
  Gene Symbol: GTF2E1
  Gene Name: general transcription factor IIE, polypeptide 1, alpha 56kDa
  ENST ID: ENST00000484715
  CDS Start-End: 396-543
gaactcattggctggtctggtaaaaggtagcggggtgcttccccagctggtcgcaggaatagtgcgttttctttgtcgcgcaaggggcgtggttcatttaagccggtagttgaagcgctgggggcagctgtagtgggagtgttccaggattcgccttgcccaggtttttaaagtaaactatatgccaatgtgggctttgagaagacagctttctgggtcatggtacggaaatgagatacacttagtttctgctttgtcaagggatccagtatttaagaatattttgggctgctctccctccctcattttctacctttttaaggactggatggtctttccttgattatcagattcaatttttcaagtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctgg

SEQ ID NO: 136858 - DNA, 503 bp, Homo sapiens
  Payload ID: 6798
  Gene Symbol: GTF2E1
  Gene Name: general transcription factor IIE, polypeptide 1, alpha 56kDa
  ENST ID: ENST00000469772
  CDS Start-End: 117-503
atttaagccggtagttgaagcgctgggggcagctgtagtgggagtgttccaggattcgccttggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaa

SEQ ID NO: 136859 - DNA, 1762 bp, Homo sapiens
  Payload ID: 6799
  Gene Symbol: GTF2E2
  Gene Name: general transcription factor IIE, polypeptide 2, beta 34kDa
  Uniprot ID: P29084
  ENST ID: ENST00000355904
  CDS Start-End: 284-1159
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctgatttccatgggtcacgtgctggggatgtgatgaagcctgcagtctgcactgtgttgctgagcacatggatttcaccactggaacacaggtgtgctgcttgttagcaagcagagcaataaagatgtgctggatgtca

SEQ ID NO: 136860 - DNA, 768 bp, Homo sapiens
  Payload ID: 6799
  Gene Symbol: GTF2E2
  Gene Name: general transcription factor IIE, polypeptide 2, beta 34kDa
  ENST ID: ENST00000523499
  CDS Start-End: 65-286
gccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgtcttcccagttgtttatacagttgcgtgggatgtgctgaacaccttgggagaatgaactacatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaag

SEQ ID NO: 136861 - DNA, 426 bp, Homo sapiens
  Payload ID: 6799
  Gene Symbol: GTF2E2
  Gene Name: general transcription factor IIE, polypeptide 2, beta 34kDa
  ENST ID: ENST00000518445
  CDS Start-End: 49-426
tgctcatacgcggactgctttctaggctaccttttggagatttgcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaac

SEQ ID NO: 136862 - DNA, 737 bp, Homo sapiens
  Payload ID: 6799
  Gene Symbol: GTF2E2
  Gene Name: general transcription factor IIE, polypeptide 2, beta 34kDa
  ENST ID: ENST00000518599
  CDS Start-End: 142-737
gtcaggaggtttggttcctggccctggctcttccatctgtgcgaccttaaccagacagcttcacttcagatttcacgtattaaaataggaataacactaatacctgtttgctcctagagttgcgagggtcaaatactcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaa

SEQ ID NO: 136863 - DNA, 2731 bp, Homo sapiens
  Payload ID: 6800
  Gene Symbol: GTF2F1
  Gene Name: general transcription factor IIF, polypeptide 1, 74kDa
  Uniprot ID: P35269
  ENST ID: ENST00000394456
  CDS Start-End: 466-2019
gggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattg

SEQ ID NO: 136864 - DNA, 1705 bp, Homo sapiens
  Payload ID: 6800
  Gene Symbol: GTF2F1
  Gene Name: general transcription factor IIF, polypeptide 1, 74kDa
  ENST ID: ENST00000593678
  CDS Start-End: 1-1302
atcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctg

SEQ ID NO: 136865 - DNA, 1382 bp, Homo sapiens
  Payload ID: 6800
  Gene Symbol: GTF2F1
  Gene Name: general transcription factor IIF, polypeptide 1, 74kDa
  ENST ID: ENST00000595047
  CDS Start-End: 239-1382
gttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaaatactccctgcctgtcctccctcctccccaaggctgagttcacaataatctccacatcttgggttcccccaaatcttcgtccctccatctgctcttcttctgcctggggtcaggagaggatgggtctagcttctctggcagactgggaatccttggagtcttccgtatccagtgttgccaggcaaaacaggctgaatgaagctgggaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaagg

SEQ ID NO: 136866 - DNA, 568 bp, Homo sapiens
  Payload ID: 6800
  Gene Symbol: GTF2F1
  Gene Name: general transcription factor IIF, polypeptide 1, 74kDa
  ENST ID: ENST00000598607
  CDS Start-End: 188-568
tactgccatgattcgggggatgtgtgcatgcctggaacgggcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttc

SEQ ID NO: 136867 - DNA, 2239 bp, Homo sapiens
  Payload ID: 6801
  Gene Symbol: GTF2F2
  Gene Name: general transcription factor IIF, polypeptide 2, 30kDa
  Uniprot ID: P13984
  ENST ID: ENST00000340473
  CDS Start-End: 142-891
ttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaatggcagtgttcatcattggcttattttaccgtagtgatgctgagatgagaaatgtgcaggatcatggtcagttgatgtttcttttatttgcttttaagataattagaaattaaatatctttccaaaatttgaagatatgtctcccccagtcagattataagcttctcaaaactggcttgcccccagaattttactgcttacccagcagacatgtattgaccatcacatggcaaatgatatcagcaaatcaaaagatgggcgtaggggtccagccgagacagaaaacgttagtttcaattcctggggcattaaaatgttgcttttctctttctctttaattaatttttaaatgaaaacaatacatgtatatgttagttttttctagcacaacacaatattatatattaagcgatccaaaatcatactgtcaagaccatcaaacaaaacaaagaagcttaagtgaactaagcacagggaaaagttgttttttcactcgttcattttgtcatctgcttctagatgctgcaatcaagaagtagcaaatgcccaagttgccatagtgtttgcaggaaaaaaagagaaaaaataataaaaataaggaaggagcaatgccaaaaattgaagaaaatattatataattaaagcaagaagatatctatccattgagaaaaacaatttttatattatttgcttttagcagcaaagcattagaattctgagattgttatagcactaagaagatttttattctgtgtacacactgaaaaataaaattctgagtaaagaaagtgttcccattcccca

SEQ ID NO: 136868 - DNA, 2982 bp, Homo sapiens
  Payload ID: 6802
  Gene Symbol: GTF2H1
  Gene Name: general transcription factor IIH, polypeptide 1, 62kDa
  Uniprot ID: P32780
  ENST ID: ENST00000265963
  CDS Start-End: 161-1807
gaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactcta

SEQ ID NO: 136869 - DNA, 2707 bp, Homo sapiens
  Payload ID: 6802
  Gene Symbol: GTF2H1
  Gene Name: general transcription factor IIH, polypeptide 1, 62kDa
  Uniprot ID: P32780
  ENST ID: ENST00000453096
  CDS Start-End: 669-2315
aggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaa

SEQ ID NO: 136870 - DNA, 545 bp, Homo sapiens
  Payload ID: 6802
  Gene Symbol: GTF2H1
  Gene Name: general transcription factor IIH, polypeptide 1, 62kDa
  ENST ID: ENST00000525831
  CDS Start-End: 261-545
actcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagttctcctgggaagaagtgtttgccactcaaggaatacactcaagaaaaacctggaaatcacagaaggcattcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagacctt

SEQ ID NO: 136871 - DNA, 1700 bp, Homo sapiens
  Payload ID: 6802
  Gene Symbol: GTF2H1
  Gene Name: general transcription factor IIH, polypeptide 1, 62kDa
  ENST ID: ENST00000530496
  CDS Start-End: 584-1294
ggctcacacctgtaatcccagcactttgggaggccaaggtgggcggatcacttgaggtcaggagttcaagaccagtctgaccagcatggtgaaaccccatctctactaaaaatacaaaatattagccgggcgtggtggcaggcgcctgtaatcccagcttctcaggaggctgaggcaagagaatcacttgaatgcaggaggcgaaggttgcactccagcctgagcaacagagcgggactccatctcaaaaacagagagaaattcagtttaagatgtattttgtaatgctaaaacgagttagtgctatttgttaatcttttatgtgcataatgtcacttgtttttaaatgtttgttcataaatatttaatgttcgtgagaagtaataaaagtcccatcatccagcaaattttttcagctaagcgtgtcttataataagaaaagcagaacctttttaaaaaatttttaatctattatttctcacagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttg

SEQ ID NO: 136872 - DNA, 2587 bp, Homo sapiens
  Payload ID: 6802
  Gene Symbol: GTF2H1
  Gene Name: general transcription factor IIH, polypeptide 1, 62kDa
  Uniprot ID: P32780
  ENST ID: ENST00000534641
  CDS Start-End: 345-1643
agactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaataatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcct

SEQ ID NO: 136873 - DNA, 1510 bp, Homo sapiens
  Payload ID: 6802
  Gene Symbol: GTF2H1
  Gene Name: general transcription factor IIH, polypeptide 1, 62kDa
  ENST ID: ENST00000524753
  CDS Start-End: 158-703
agatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggtatgggcaaaaaaatatgaaccatttggggctcaagtttctccaaatactttatgtgactgcaagtactgtatacgcttatttcctgtgactcagttcttctaactaagatgttaagcatttggcttaaagtgtatagcattacaaagagtatttccccagctttggcttgccagccaactttccattgactctagcctgttagccatttttattgttttttgtttgtttgtttgtttgttttcctcacatgtacacatacatacagattgttcttatatgtgattttgttctctgggaataaaatcttcattcaacagaggcaatatgacagaaaaaccgaagtttcatgtatatgatttttcaaagaaagtgaattggccctcatgttaaacctagcatttcagagctgaaagtgtcttctcattaaatattgaagaaatcatttgagggtgtggagaaggatggacagaattagctgcttgtgtatttattcttctcctgcaactttgccacgctattttgtacctcccttcctaattatgataaagctttcttagagagcagtcaggcaatgtgtattaaatgtttaaagctttacacccttagttctacttgtggacatttatttcttaagaaagatgtatactaagatttagatagaaatattcattacagtatcataataaagacagtagcaaggattctgttatctgtgttgcattaatacaatagagattgatgcaactgttcattattttgaaagcattaatgataatattgcatcaaagagttcactgaacagattgtacagtacagttttacacacaaaaaaaatagtttgtgagctttaaaagggccttcaaatgaatatgctaaacggttatctttcaataaagagagtatgggtaa

SEQ ID NO: 136874 - DNA, 932 bp, Homo sapiens
  Payload ID: 6802
  Gene Symbol: GTF2H1
  Gene Name: general transcription factor IIH, polypeptide 1, 62kDa
  ENST ID: ENST00000526630
  CDS Start-End: 487-903
atagtggagagcataacagatcattcatttggggaaaaaataataaaatgtaaactttcacctaccagattggcaaaagtaaaaagttcaataatacttcatgtggtcagagtgtaagaaaactagtattcttaagtagttgttgagaaaattggttcagccatttgtaggacagtcatctctaggaagagaagctcatggtgggaagacttcattttttaccctctgtacagttttgttttttcagtcatgtttattgtgtaagagaaagttgtgacaaaataaaaagtactgtgttaataattataggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtga

SEQ ID NO: 136875 - DNA, 4336 bp, Homo sapiens
  Payload ID: 6803
  Gene Symbol: GTF2H2
  Gene Name: general transcription factor IIH, polypeptide 2, 44kDa
  Uniprot ID: Q13888
  ENST ID: ENST00000274400
  CDS Start-End: 142-1329
ctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccaagattgtgccactgcactccaccctagagtgagactccatctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaatcatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgcgcagaactctttctggttatatccagttaagagtaaatcaggctttcagccgggcgcggtggctcacgcctgtaatcctagcactttgggaggccgaggcgggcagatcacgaggtcaggagatcgagaccatcctggctaacacggtgaaaccccgtctctactaaacatacaaaaaattagctgggcctggtggcgggcgcctgtagtcccagctattcggaaggctggggcaggagaatggtgtgaacccaggaggcggagcttgcagtgagccgagatcgctccactgccctccagcctgggcgacagagctagactctgtctcaagaaaaaaaaaaaaagagtaaatcaggctttcatagcaaaggtatgtctattttatgtatataaacttcaggtactctaacttgagtttcactatgaaatttgtgattttttttttttttttttttgagatggagtcttgctccatcgcccaggctggagtgcagtggcctgctgttggctcactgcaacctccgcctcccaggctcaagccattctcctgtctcagcctcctgagtagctgggactacaggcgcctgccaccacgcctggctaatttttgcatttttggtagagacggggtttcaccttgttgatcaggctgatctccaactcctgacctcaggtcatccacccacctccgccaccgtgcccggccgaaatttgtgattttataactaagaatttttagttaagaacattatcagtaaagacaacgtaatcccaccctggagagtttattgggagcccaggaatattcatttttaatacacacacacacacacacacacacacacacacacacactgatcagagtaacaggagtttctctcaggagtcatactccatgagcctggacccagtggttctttacgtggaaacaaatttcacctataggtaacctggtaactgctattttcttctgtgtgctctgtcaacaaagttatcagtggcttgcaagagatgcctttaatactcagagcattctatctccccctatctggtttagaaggaaggccttcattagttaccttttgagaagttactagaactctctattagagacttaccctcctgacctgataaaaagggatacccatgtctctattaacagctttatctctttctacagttttgggtatttgataaggttaaggcaaaattttagttatgcttaaggaggagttcttttttcacaattacagagaaaattttggtttgttgaagattgcagaaacagcaatggtaatgtaagacagttttggcctttaatttttttcttgaaactctacagtatactacaatagtgaaggaaactattaacatgagagatccttctgaataggatgtctttctgagttccactattcagttacaaaactccttaatgcttaaaattcattatgaaaattagatttattttaaatactttcaagtgtatacatttttatttcataatttttattgtcttttaactaaagcatttagttcatttatatttactgtgtaccttttatatttaataaatatatttacttattaaaagatta

SEQ ID NO: 136876 - DNA, 2077 bp, Homo sapiens
  Payload ID: 6803
  Gene Symbol: GTF2H2
  Gene Name: general transcription factor IIH, polypeptide 2, 44kDa
  Uniprot ID: Q13888
  ENST ID: ENST00000330280
  CDS Start-End: 289-1476
gtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctgccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctact

SEQ ID NO: 136877 - DNA, 1950 bp, Homo sapiens
  Payload ID: 6803
  Gene Symbol: GTF2H2
  Gene Name: general transcription factor IIH, polypeptide 2, 44kDa
  ENST ID: ENST00000425596
  CDS Start-End: 142-297
ctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagggagcc

SEQ ID NO: 136878 - DNA, 1953 bp, Homo sapiens
  Payload ID: 6803
  Gene Symbol: GTF2H2
  Gene Name: general transcription factor IIH, polypeptide 2, 44kDa
  ENST ID: ENST00000519783
  CDS Start-End: 142-297
ctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccaag

SEQ ID NO: 136879 - DNA, 659 bp, Homo sapiens
  Payload ID: 6803
  Gene Symbol: GTF2H2
  Gene Name: general transcription factor IIH, polypeptide 2, 44kDa
  ENST ID: ENST00000517900
  CDS Start-End: 193-564
gagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggtgtttgattccagcatgtagtatacattgtatgtgttaaaaagaaatttgcaactgtgaataaaaggacttctttagaagaagcttcatttaaaacatgaaa

SEQ ID NO: 136880 - DNA, 1569 bp, Homo sapiens
  Payload ID: 6803
  Gene Symbol: GTF2H2
  Gene Name: general transcription factor IIH, polypeptide 2, 44kDa
  ENST ID: ENST00000518898
  CDS Start-End: 1-457
ggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacggggtttcaccgtgttagccaggatggtctcgatctcctgacctcgtgatgtgcccgcttcagcctcccaaagtgctgggaatacagacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaa

SEQ ID NO: 136881 - DNA, 457 bp, Homo sapiens
  Payload ID: 6803
  Gene Symbol: GTF2H2
  Gene Name: general transcription factor IIH, polypeptide 2, 44kDa
  ENST ID: ENST00000521602
  CDS Start-End: 387-457
ccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggtaactttcgtctggggagccgcagagtagggagggaagctgcaggccgtctctccctaagtaaaagcgcgacttttagaaatgatggttcagggttcgagtttgtgacccgcttgagaaagtgaccaacctctgagcctgaatcccatacctgaaaaacaaggacagtaatcacccttgccagtttcacatagcttgattattgaataataaaatacagttttgaaaaaaatggatgaagaacctgaaagaactaagcgatgggaaggaggctatgaaagaacatgggagattcttaaaga

SEQ ID NO: 136882 - DNA, 1803 bp, Homo sapiens
  Payload ID: 6803
  Gene Symbol: GTF2H2
  Gene Name: general transcription factor IIH, polypeptide 2, 44kDa
  Uniprot ID: Q13888
  ENST ID: ENST00000619997
  CDS Start-End: 289-1476
gtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctgccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 136883 - DNA, 1958 bp, Homo sapiens
  Payload ID: 6803
  Gene Symbol: GTF2H2
  Gene Name: general transcription factor IIH, polypeptide 2, 44kDa
  Uniprot ID: Q13888
  ENST ID: ENST00000617228
  CDS Start-End: 196-1383
ggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggt

SEQ ID NO: 136884 - DNA, 486 bp, Homo sapiens
  Payload ID: 6803
  Gene Symbol: GTF2H2
  Gene Name: general transcription factor IIH, polypeptide 2, 44kDa
  ENST ID: ENST00000615242
  CDS Start-End: 475-486
aagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggtaactttcgtctggggagccgcagagtagggagggaagctgcaggccgtctctccctaagtaaaagcgcgacttttagaaatgatggttcagggttcgagtttgtgacccgcttgagaaagtgaccaacctctgagcctgaatcccatacctgaaaaacaaggacagtaatcacccttgccagtttcacatagcttggctggagtgcagtggcacaaccttggctcgctccagtgtctacctgccaggttcaagtgattctcctgcctcagcctcccgagtagctgggattacagattattgaataataaaatacagttttgaaaaaaatggatgaagaa

SEQ ID NO: 136885 - DNA, 1954 bp, Homo sapiens
  Payload ID: 6803
  Gene Symbol: GTF2H2
  Gene Name: general transcription factor IIH, polypeptide 2, 44kDa
  ENST ID: ENST00000616846
  CDS Start-End: 142-297
ctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagggagccgaga

SEQ ID NO: 136886 - DNA, 2077 bp, Homo sapiens
  Payload ID: 6803
  Gene Symbol: GTF2H2
  Gene Name: general transcription factor IIH, polypeptide 2, 44kDa
  Uniprot ID: Q13888
  ENST ID: ENST00000612581
  CDS Start-End: 289-1476
gtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctgccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctact

SEQ ID NO: 136887 - DNA, 395 bp, Homo sapiens
  Payload ID: 6803
  Gene Symbol: GTF2H2
  Gene Name: general transcription factor IIH, polypeptide 2, 44kDa
  ENST ID: ENST00000621171
  CDS Start-End: 387-395
ccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggtaactttcgtctggggagccgcagagtagggagggaagctgcaggccgtctctccctaagtaaaagcgcgacttttagaaatgatggttcagggttcgagtttgtgacccgcttgagaaagtgaccaacctctgagcctgaatcccatacctgaaaaacaaggacagtaatcacccttgccagtttcacatagcttgattattgaataataaaatacagttttgaaaaaaatggatgaa

SEQ ID NO: 136888 - DNA, 612 bp, Homo sapiens
  Payload ID: 6803
  Gene Symbol: GTF2H2
  Gene Name: general transcription factor IIH, polypeptide 2, 44kDa
  ENST ID: ENST00000621491
  CDS Start-End: 193-564
gagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggtgtttgattccagcatgtagtatacattgtatgtgttaaaaagaaatttgcaact

SEQ ID NO: 136889 - DNA, 457 bp, Homo sapiens; identical to SEQ ID NO: 136881
  Payload ID: 6803
  Gene Symbol: GTF2H2
  Gene Name: general transcription factor IIH, polypeptide 2, 44kDa
  ENST ID: ENST00000626970
  CDS Start-End: 387-457

SEQ ID NO: 136890 - DNA, 4340 bp, Homo sapiens
  Payload ID: 6803
  Gene Symbol: GTF2H2
  Gene Name: general transcription factor IIH, polypeptide 2, 44kDa
  Uniprot ID: Q13888
  ENST ID: ENST00000628423
  CDS Start-End: 142-1329
ctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagggagccgagattgtgccactgcactccaccctagagtgagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcctgtaatcctagcactttgggaggccgaggcgggcagatcacgaggtcaggagatcgagaccatcctggctaacacggtgaaaccccgtctctactaaacatacaaaaaattagctgggcctggtggcgggcgcctgtagtcccagctattcggaaggctggggcaggagaatggtgtgaacccaggaggcggagcttgcagtgaaccgagatcgctccactgcactccagcctgggcgacagagctagactctgtctcaagaaaaaaaaaaaaaaaaagagtaaatcaggctttcatagcaaaggtatgtctattttatgtatataaacttcaggtactctaacttgagtttcactatgaaatttgtgattttttttttttttttttgagatggagtcttgctccatcgcccaggctggagtgcagtggcctgctgttggctcactgcaacctccgcctcccaggctcaagccattctcctgtctcagcctcctgagtagctgggactacaggcgcctgccaccacgcctggctaatttttgcatttttggtagagacggggtttcaccttgttgatcagtctgatctccaactcctgacctcaggtcatccacccacctccgccaccgtgcccggccgaaatttgtgattttataactaagaatttttagttaagaacattatcagtaaagacaacgtaatcccaccctggagagtttattgggagcccaggaatattcatttttaatacacacacacacacacacacacacacacacacacacacactgatcagagtaacgggagtttctctcaggagtcatactccatgagcctggacccagtggttctttatgtggaaacaaatttcacctataggtaacctggtaactgctattttcttctgtgtgctctgtcaacaaaggtatcagtggcttgcaggagatgcctttaatactcagagcattctatctccccctatctggtttagaaggaaggccttcattagttaccttttgagaagttactagaactctctattagagacttaccctcctgacctgataaaaagggatacccatgtctctattaacagctttatctctttctacagttttgggtatttgataaggttaaggcaaaattttagttatgcttaaggaggagttcttttttcacaattacagagaaaattttggtttgttgaagattgcagaaacagcaatggtaatgtaagacagttttggcctttaatttttttcttgaaactctacagtatactacaatagtgaaggaaactattatcatgagagatccttctgaataggatgtctttctgagttccactattcagttacaaaactccttaatgcttaaaattcattatgaaaattagatttattttaaatactttcaagtgtatacatttttatttcataatttttattgtcttttaactaaagcatttagttcatttatatttactgtgtaccttttatatttaataaatatatttacttattaaaagatta

SEQ ID NO: 136891 - DNA, 659 bp, Homo sapiens; identical to SEQ ID NO: 136879
  Payload ID: 6803
  Gene Symbol: GTF2H2
  Gene Name: general transcription factor IIH, polypeptide 2, 44kDa
  ENST ID: ENST00000630141
  CDS Start-End: 193-564

SEQ ID NO: 136892 - DNA, 1569 bp, Homo sapiens
  Payload ID: 6803
  Gene Symbol: GTF2H2
  Gene Name: general transcription factor IIH, polypeptide 2, 44kDa
  ENST ID: ENST00000630101
  CDS Start-End: 1-457
ggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacggggtttcaccgtgttagccaggatggtctcgatctcctgacctcgtgatgtgcccgcttcagcctcccaaagtgctgggaatacagacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaa

SEQ ID NO: 136893 - DNA, 1472 bp, Homo sapiens
  Payload ID: 6804
  Gene Symbol: GTF2H3
  Gene Name: general transcription factor IIH, polypeptide 3, 34kDa
  Uniprot ID: Q13889
  ENST ID: ENST00000228955
  CDS Start-End: 75-878
acttgctctgcgctgaggtgctgggacagccatggtttcagacgttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctca

SEQ ID NO: 136894 - DNA, 582 bp, Homo sapiens
  Payload ID: 6804
  Gene Symbol: GTF2H3
  Gene Name: general transcription factor IIH, polypeptide 3, 34kDa
  ENST ID: ENST00000543154
  CDS Start-End: 1-582
aaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcc

SEQ ID NO: 136895 - DNA, 552 bp, Homo sapiens
  Payload ID: 6804
  Gene Symbol: GTF2H3
  Gene Name: general transcription factor IIH, polypeptide 3, 34kDa
  ENST ID: ENST00000542279
  CDS Start-End: 33-236
cacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaaggtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctg

SEQ ID NO: 136896 - DNA, 907 bp, Homo sapiens
  Payload ID: 6804
  Gene Symbol: GTF2H3
  Gene Name: general transcription factor IIH, polypeptide 3, 34kDa
  ENST ID: ENST00000543415
  CDS Start-End: 112-714
gaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcccaaggcattgctcatgagaacctcattcctctggaaaccctagtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttc

SEQ ID NO: 136897 - DNA, 790 bp, Homo sapiens
  Payload ID: 6804
  Gene Symbol: GTF2H3
  Gene Name: general transcription factor IIH, polypeptide 3, 34kDa
  ENST ID: ENST00000536375
  CDS Start-End: 16-790
ggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaa

SEQ ID NO: 136898 - DNA, 555 bp, Homo sapiens
  Payload ID: 6804
  Gene Symbol: GTF2H3
  Gene Name: general transcription factor IIH, polypeptide 3, 34kDa
  ENST ID: ENST00000538533
  CDS Start-End: 111-555
aagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggcccaaggcattgctcatgagaacctcattcctctggaaaccctagtgggtgtttcttcccgatcaagatcagagatctcag

SEQ ID NO: 136899 - DNA, 3329 bp, Homo sapiens
  Payload ID: 6804
  Gene Symbol: GTF2H3
  Gene Name: general transcription factor IIH, polypeptide 3, 34kDa
  Uniprot ID: Q13889
  ENST ID: ENST00000543341
  CDS Start-End: 32-958
acttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaacgtggtgaaaacatggtgaaaccctgtctctactaaaaatacaaaaattagctgggcgtggtggcaggtgcctgtaatcccagctactcaggagactgaggcaggagaattgcttgaacccaggaggtggaggttgcagtgagccaagatcaagattgcgccattgcactccagcctgggcgacaagaacaaaactctgtctcaaaaaaaaaaaaaaaaaaaaagtctgtactgataaaacccattgtgtacaaaactttgtatgtaaggaagattttaattttctctttatacaagctgagtcatatttaaataatttgatgttggcttagataatttcagatagattttatattctggatttgtgtttttgttaacaaatatacaaagactttggtgatcactttgcaaatatttgttaatccttgagtttgagaacctgtcttttaaaaataatattttgtatactaattaagtgtaatggaaatcacaattttaagtctaggaaataaagtattatatatactttcaaacaagctagcaaggcttttattattacttttttatttgaaatatcttatatatttggttagttctgtttaacttgtttttaactgttgcccttatgagttattttatataaatttttacaataaaataatttgattttcata

SEQ ID NO: 136900 - DNA, 663 bp, Homo sapiens
  Payload ID: 6804
  Gene Symbol: GTF2H3
  Gene Name: general transcription factor IIH, polypeptide 3, 34kDa
  ENST ID: ENST00000538845
  CDS Start-End: 32-663
acttgctctgcgctgaggtgctgggacagccatggtttcagacgaagatgaattgaatcttctggttattgtagttgatgccaacccaatttggtggggaaagcaagcattaaaggaatctcagcaccaccatctcatgcctcagcctcccgagtacttgggactacagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgtttt

SEQ ID NO: 136901 - DNA, 562 bp, Homo sapiens
  Payload ID: 6804
  Gene Symbol: GTF2H3
  Gene Name: general transcription factor IIH, polypeptide 3, 34kDa
  ENST ID: ENST00000539994
  CDS Start-End: 32-562
acttgctctgcgctgaggtgctgggacagccatggtttcagacgttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacag

SEQ ID NO: 136902 - DNA, 3252 bp, Homo sapiens
  Payload ID: 6804
  Gene Symbol: GTF2H3
  Gene Name: general transcription factor IIH, polypeptide 3, 34kDa
  ENST ID: ENST00000618160
  CDS Start-End: 396-884
gggggctggcacgagtcacagcacctcgtgcgtcacttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaaggtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaacgtggtgaaaacatggtgaaaccctgtctctactaaaaatacaaaaattagctgggcgtggtggcaggtgcctgtaatcccagctactcaggagactgaggcaggagaattgcttgaacccaggaggtggaggttgcagtgagccaagatcaagattgcgccattgcactccagcctgggcgacaagaacaaaactctgtctcaaaaaaaaaaaaaaaaaaaaagtctgtactgataaaacccattgtgtacaaaactttgtatgtaaggaagattttaattttctctttatacaagctgagtcatatttaaataatttgatgttggcttagataatttcagatagattttatattctggatttgtgtttttgttaacaaatatacaaagactttggtgatcactttgcaaatatttgttaatccttgagtttgagaacctgtcttttaaaaataatattttgtatactaattaagtgtaatggaaatcacaattttaagtctaggaaataaagtattatatatactttcaaacaagctagcaaggcttttattattacttttttatttgaaatatcttatatatttggttagttctgtttaacttgtttttaactgttgcccttatgagttattttatataaatttttacaataaaataatttgattttc

SEQ ID NO: 136903 - DNA, 1735 bp, Homo sapiens
  Payload ID: 6805
  Gene Symbol: GTF2H4
  Gene Name: general transcription factor IIH, polypeptide 4, 52kDa
  Uniprot ID: Q92759
  ENST ID: ENST00000259895
  CDS Start-End: 224-1612
attctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 136904 - DNA, 1673 bp, Homo sapiens
  Payload ID: 6805
  Gene Symbol: GTF2H4
  Gene Name: general transcription factor IIH, polypeptide 4, 52kDa
  Uniprot ID: Q92759
  ENST ID: ENST00000376316
  CDS Start-End: 162-1550
ctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 136905 - DNA, 1735 bp, Homo sapiens; identical to SEQ ID NO: 136903
  Payload ID: 6805
  Gene Symbol: GTF2H4
  Gene Name: general transcription factor IIH, polypeptide 4, 52kDa
  Uniprot ID: Q92759
  ENST ID: ENST00000376326
  CDS Start-End: 224-1612

SEQ ID NO: 136906 - DNA, 1673 bp, Homo sapiens; identical to SEQ ID NO: 136904
  Payload ID: 6805
  Gene Symbol: GTF2H4
  Gene Name: general transcription factor IIH, polypeptide 4, 52kDa
  Uniprot ID: Q92759
  ENST ID: ENST00000400450
  CDS Start-End: 162-1550

SEQ ID NO: 136907 - DNA, 1673 bp, Homo sapiens
  Payload ID: 6805
  Gene Symbol: GTF2H4
  Gene Name: general transcription factor IIH, polypeptide 4, 52kDa
  Uniprot ID: Q92759
  ENST ID: ENST00000438348
  CDS Start-End: 162-1550
ctcccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 136908 - DNA, 1673 bp, Homo sapiens; identical to SEQ ID NO: 136904
  Payload ID: 6805
  Gene Symbol: GTF2H4
  Gene Name: general transcription factor IIH, polypeptide 4, 52kDa
  Uniprot ID: Q92759
  ENST ID: ENST00000435498
  CDS Start-End: 162-1550

SEQ ID NO: 136909 - DNA, 598 bp, Homo sapiens
  Payload ID: 6805
  Gene Symbol: GTF2H4
  Gene Name: general transcription factor IIH, polypeptide 4, 52kDa
  ENST ID: ENST00000430576
  CDS Start-End: 185-598
cccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggtacagggattacaggtgtgagccactgcgcctggccaggg

SEQ ID NO: 136910 - DNA, 598 bp, Homo sapiens
  Payload ID: 6805
  Gene Symbol: GTF2H4
  Gene Name: general transcription factor IIH, polypeptide 4, 52kDa
  ENST ID: ENST00000456195
  CDS Start-End: 185-598
cccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggtacagggattacaggtgtgagccactgcgcctggccaggg

SEQ ID NO: 136911 - DNA, 1735 bp, Homo sapiens; identical to SEQ ID NO: 136903
  Payload ID: 6805
  Gene Symbol: GTF2H4
  Gene Name: general transcription factor IIH, polypeptide 4, 52kDa
  Uniprot ID: Q92759
  ENST ID: ENST00000456968
  CDS Start-End: 224-1612

SEQ ID NO: 136912 - DNA, 1735 bp, Homo sapiens; identical to SEQ ID NO: 136903
  Payload ID: 6805
  Gene Symbol: GTF2H4
  Gene Name: general transcription factor IIH, polypeptide 4, 52kDa
  Uniprot ID: Q92759
  ENST ID: ENST00000413314
  CDS Start-End: 224-1612

SEQ ID NO: 136913 - DNA, 598 bp, Homo sapiens
  Payload ID: 6805
  Gene Symbol: GTF2H4
  Gene Name: general transcription factor IIH, polypeptide 4, 52kDa
  ENST ID: ENST00000454718
  CDS Start-End: 185-598
cccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggtacagggattacaggtgtgagccactgcgcctggccaggg

SEQ ID NO: 136914 - DNA, 598 bp, Homo sapiens; identical to SEQ ID NO: 136910
  Payload ID: 6805
  Gene Symbol: GTF2H4
  Gene Name: general transcription factor IIH, polypeptide 4, 52kDa
  ENST ID: ENST00000423849
  CDS Start-End: 185-598

SEQ ID NO: 136915 - DNA, 1673 bp, Homo sapiens
  Payload ID: 6805
  Gene Symbol: GTF2H4
  Gene Name: general transcription factor IIH, polypeptide 4, 52kDa
  Uniprot ID: Q92759
  ENST ID: ENST00000416773
  CDS Start-End: 162-1550
ctcccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 136916 - DNA, 1735 bp, Homo sapiens
  Payload ID: 6805
  Gene Symbol: GTF2H4
  Gene Name: general transcription factor IIH, polypeptide 4, 52kDa
  Uniprot ID: Q92759
  ENST ID: ENST00000440824
  CDS Start-End: 224-1612
attctcatcctcttcacttttccactcctccccttacctcccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 136917 - DNA, 1735 bp, Homo sapiens
  Payload ID: 6805
  Gene Symbol: GTF2H4
  Gene Name: general transcription factor IIH, polypeptide 4, 52kDa
  Uniprot ID: Q92759
  ENST ID: ENST00000434226
  CDS Start-End: 224-1612
attctcatcctcttcacttttccactcctccccttacctcccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 136918 - DNA, 1673 bp, Homo sapiens; identical to SEQ ID NO: 136904
  Payload ID: 6805
  Gene Symbol: GTF2H4
  Gene Name: general transcription factor IIH, polypeptide 4, 52kDa
  Uniprot ID: Q92759
  ENST ID: ENST00000423881
  CDS Start-End: 162-1550

SEQ ID NO: 136919 - DNA, 598 bp, Homo sapiens; identical to SEQ ID NO: 136910
  Payload ID: 6805
  Gene Symbol: GTF2H4
  Gene Name: general transcription factor IIH, polypeptide 4, 52kDa
  ENST ID: ENST00000416161
  CDS Start-End: 185-598

SEQ ID NO: 136920 - DNA, 7481 bp, Homo sapiens
  Payload ID: 6806
  Gene Symbol: GTF2H5
  Gene Name: general transcription factor IIH, polypeptide 5
  Uniprot ID: Q6ZYL4
  ENST ID: ENST00000607778
  CDS Start-End: 79-294
actctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctggcctggacaacagagagaccctgcctcaaaaaaaaaaaaaaaaaaaaaaaaaattctacttgtaccttattccctatgagaatacttatcaaacttatctaaaaaagaaaaataggaacagccatatgcaaagtcagcccaacaggaaaggacatattagattaaaatacattgcggcctgggcttagtggctcacacctgtaatcccagcactttgggaggctgaggcaggcagatcgcttgagtccaggagtcgaaaccctgtctctacaaaaaaaaaaatacaaaaatctgcctgttgtcccagccactggggaggctgaggtaggaggtcaaggctgcagtgaaccttgatcattgctactgccactccagcctaggtgacagagtgagaccctgtctccaaaaaaaaaagtgtatatgtatgtgtgtatatatagcaagagagagttctgtgatcaattgaaggcaaaaacagtaacactgagaggggctttgcttcccttcctgaagatcatgtcattggggtgggttcctgtaaagggaattttccaagagaaaagagaattttcatgacctgtagactcttacaaatccattttacctgcttccttatggtatgtttattcaaagcacctgtgtaccatatttattcacttacacagcattactgaatctggaaattttcagttaggtatattttacataattcccacccatataactcagtccatacagttcacagttttcattccctcatagcaatgcaaaaaattttgatgagttactactactaaaactagttaagtaaaagatgattcttaagaatttccaggctgggcacggtggctcacgcctgtaatcccagcactttgggaggctgaggcaggcagctcacgaggtcaggagatcgagaccatcctgctcggtgaaaccccatctctattaaaaatacaaaaaattagccgggcctggtggcgggtgcctgtagtcccatctactcaggaggctgaggcaggagaatggcgtgaacccgggaggcggagcttgcagtaagctgagattgtgccactgcactccagcctgggcgacagagggagactccatctcaaaaaaaaaaaaaaaaaaaaatgaatttccagctataccaaaatgttactaatgtatcttatatttcaggcatgtctaaatcaacttttagtatgcctcaggcatttgtcaccaaccttttatattaacatgaaacttagaaaatttttgatagaatcccagagttcaaaaggtattaggatttttgccactgaagtaaaaaagagaaaaaaagatatttatgagaaaactattgaacagtgactgtgttgtacccgagcaagttagaggaacgccacactttgagacgaatttaaaagtcctttatttagctggcagccaagaggtggctcacacttggaattctctcagctccgaggaaggggcttgattttcctttatactttggtttaggaaggggacgggagctcagttgcaacaattctacagaagtaaaaacatgcaaaaaattaaaaagacaaatggttacagagaaacaaacagttccaggtgcaggggctctaaatctatcataagatgtcaggtgtgggggctctgccagacacaaactcaaggctttatggtgtatctcttgagcgaaatcctgggaacttcgtacattgcttgcttcagtaccttatgagttaattggactctttgatatgttgagagtcagcttacacaagttaactccttgaggaaagggggtgggtaaggagtccttgatgtcctgtaaatgaaggaaccaaatggagttcctccggctttctcagctaagggagagcttattcacatggaaacaaggctaggtgattaagggagaaagggacagtctgaaaacaaggttagtaaaaacaaggttaggtattagaactgcaaagagtattaagtgaaataagtgaaggaaaatatgagctcttatttttaaaaagttgtgttggggcaaatgttaaatatctttctttctctggacattattaagaaagatagagtgatgtgaatgataggaagcccacctgtaaccacttagctgacatgtccaactatgggtgaacaggaaataagcgacattcacctaggctgtttattggaatctgactagcattatttgatttggcatactttacatgtccagaacaaggctgttggtgcttggcaccaagaaatttatgactttttttttttttttaaataaagtcctaaaggtagcattaaaatgacttaactggaggcaggaggatcactgaagcccaggagtttgaagctgcagtaagctaagaaggtgccactgcactgcagcctggatgacagagtgaaactttgtctcttaatagaactatggactgaagttgtgatattgagtgttatatttctcaataaaggttttttcttttaatactgtattaggtcaaattcaaggtcttaattccttgaattccaatttccttgtgaaatttcatgtgattaatttaaaattccagggatcctatctaacatcacagttgatggatataacaatgtattttgagaaatcagttttggtgaacagtaacagcattactgataataggcaacaaacactactgcattttatttctgataggcattataggtggtaatccaaatgattaatgattttattgctctttacattttctagaacaggtgatttgacataattgtacttttttctgagaagttggtagtgtacttactactctattttgcagttatacaataaatcttacttagctgacaactaggagtaaaagctctgacaaaaagcctctgctgtaactaaaatactgagatcattctatcttaacaaacttaacagatggggaaggggtatattttaaagatggagaaatgatgcagtttgcaaatatagtcaataaatattctcaagtgtacgtagctcaatttcatttgcagcaaagataacactgaaatgtctatggatgagattattggataaacttttttaaaaacactgttctcaagataggcaagtgattaagagcactgactgggccgggcgcggtggctcacgtctataatcctagcactttgggaggccgaggcgggcaaatcacaaggtcaggagatcaaaacaatcctggctaacaaggtgaaaccccgtctctactaaaaatacaaaaaaattagctgggcatggtggtggacgcctgtagtcccagctactcgggaggctgaggcaggagaatggtgtaatcccgggaggtggaggttgcagtgagccgagatcgtgccactgcactccagccggggtgacagagcgagactcccacccatctcaaaaaaaataaaaatgaaaagcactgattgaatctagattccttgagtccaagtgtcagatctctgcttactagctctgggatctcagatgtttcgttgattggatttctttgtgctcatttgtgtaaacaggaatgcccgtctttaaagactattaaaatgaatgtgagttaacacacaagaggtcttcaaaaagttgatggaaaatgcatattatgaaaaaaattatgcatagatttcaaaaatctttgcagcaaaataaactcatcattataacatgtctgaacaggatctagtttgaggcactaagaaggatatcagtttaaatagagcccctgtcagaacaatatgaattctgctaaaactgaagcaagaacaaacatcaaatttatggcaaagcttaggtggaagaatggtgcaatcattgatgctttgcaaaaagtttatgggaacaacgccccaaggaaatcagtttacaaatggataattcattttaagaaaggacaagacaatgttgaagatgaaacctacagcagcagaccatgccacttcgtgaggaaaaaattatctcattcatgccctacttgaagaggaccaatgattaacagcagaaacgatagccaacacaatatgctcctcagttggttcagcttttataaatctgactgaaaaattaaagttgagcacactttccactcaatggataccaaaaccatccagcccaggtcagctgcagacaaaagcagagctttcgatggaaatgtcaaacaagtgagatcaagatcctgaagcatttcttcaaagaattgtagcaaaaacagacttttaaaaccttgaattcagagacaggtataaagactgcttggtgattttgaaaggactgagatcattttgggagagatcatcttcagaaaatgaccagatacaacaagaatttaacatggcagccaaaccaacccactaacacacatttaaataagatacccaaatgcagaaagaaaagcacagtcgtcatgcaaaatagtcactactcattcaaaaactctatagttgtctgagtcgttatgctcaaaatatccaataatatttcttttgctgagctgtaaaataattattttgcaaacataaaagaaaaaaaaaagaattgtaacagaaacatggctttaccagtatgaccctcaagacaaaatacaaaacaatggctaccaagaggtggaagtggcccagtcacagcaagagcagattgatcaagagcaaaggtcatggtaacagttttttggatcctcaagtcattttgcttgttgactttttggagggccaaataaagatatcatctgcttattatgagagtgtttcgagagaaatccaaagcttagcagagaaacgcctgggaaagcttcaccagagggtcttccaccgtgacagttcccctgcgcattcctctcataaagcaagggcagtttagctagaatttctatcaaaaatcattaggtatccatctcccagtcctgatttggctccttctgacttctttttgtttcccaatcttaaaaaaatccctgaagggcacctgtttttcttcagctaataaaaaagacatggttaatttcccaggaccctcagttctttagggatagactgaatggctggtatcattgcttgaacttaatggagcttatgttgagaaataaaagaaattatattttatttttatcttttaattctatttttccatgaactttttgaagtcccctcagatataaagcagaacgttatgaaactgagttaccttgaatctagaagagtacaatgataaaggggaagatagaaacacacacatatgcgttgttttccccactttcacaatgccgtgcagaaactaacagatgaaggaggagaatccctaaaaacagagcattgggtagctagtccaccagcggtctgatgctttcattgatctcaaaactgtctctgagtaactctaccaggaaagttgtctggagggttaacatttctgaaaccatttttatctttgccttcattcttgaatgataattagtctcgaatgtttggatcacaatccattgaaagactaggctattttttcactgtcctcagacatttactgagtccagtttggactttattttattttattttttttgaaacaagatctcgctctgttgctcaggctgaagtgcaatagcgcaaactcggctcactgcaacctcccaggttcaagcaattctcgtgcctcagccatccctataggcatgcgccaccacactttgctaatcttgtatttttggtagagacggggtttgcaccatgttggccaggctggtctcgaactcccaacctcaagtaatctggcctcccaaagtggtgggattacaggcgtgagccagcgcgcccggcctggacttaacttctgaagaactctttctgtttagattgcaggagcgttctctcggctcatctcttgttttctcacccagctgttcttcttctagttggccatcattcttcatccctccctccctttcctgcagttaattatttctttgaaattttaaaacttcttaatgttgcctggaatacatgagtcttcctgatctcttcaaacggggtttgttttgttttgctttggggagaattcttttgacgtttttgaataagctgttaacaactttaatacctgtcttgtttgttttcttcagaaatttgttaattctccatgattagcacctttatgtggttatctcattattttcattcctttttaattctctgttttaggaatgcttgtcaaattcgtcactaaaattgatttactttcttgaaaacctgtttctgctgctcccaacatgatttaatcttggctactgagcttttggttacgttgcactccctttaaaattactccgtttaagtacagtgttcactctttgggtaatgtgtacaatagaagcccaatccccacctatacccaatatatccatgggacaagcatgtacatgcaccccctgagtctaaaataaaaattttaaaaaaacta

SEQ ID NO: 136921 - DNA, 979 bp, Homo sapiens
  Payload ID: 6807
  Gene Symbol: GTF2I
  Gene Name: general transcription factor IIi
  Uniprot ID: P78347
  ENST ID: ENST00000443166
  CDS Start-End: 44-868
ccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggta

SEQ ID NO: 136922 - DNA, 572 bp, Homo sapiens
  Payload ID: 6807
  Gene Symbol: GTF2I
  Gene Name: general transcription factor IIi
  ENST ID: ENST00000432143
  CDS Start-End: 254-572
atttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagcgtctgtcccccatttcttacacacattgagtgtgattgttaccagtggagggtgtccaatggaagaagcaccaaaagccgagatttattgaaagtggaagggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctg

SEQ ID NO: 136923 - DNA, 4548 bp, Homo sapiens
  Payload ID: 6807
  Gene Symbol: GTF2I
  Gene Name: general transcription factor IIi
  Uniprot ID: P78347
  ENST ID: ENST00000573035
  CDS Start-End: 390-3386
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtagttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 136924 - DNA, 4352 bp, Homo sapiens
  Payload ID: 6807
  Gene Symbol: GTF2I
  Gene Name: general transcription factor IIi
  Uniprot ID: P78347
  ENST ID: ENST00000620879
  CDS Start-End: 317-3190
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtagttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 136925 - DNA, 4412 bp, Homo sapiens
  Payload ID: 6807
  Gene Symbol: GTF2I
  Gene Name: general transcription factor IIi
  Uniprot ID: P78347
  ENST ID: ENST00000621734
  CDS Start-End: 317-3250
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtagttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 136926 - DNA, 4415 bp, Homo sapiens
  Payload ID: 6807
  Gene Symbol: GTF2I
  Gene Name: general transcription factor IIi
  Uniprot ID: P78347
  ENST ID: ENST00000614986
  CDS Start-End: 317-3253
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtagttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 136927 - DNA, 1383 bp, Homo sapiens
  Payload ID: 6808
  Gene Symbol: GTF3A
  Gene Name: general transcription factor IIIA
  Uniprot ID: Q92664
  ENST ID: ENST00000381140
  CDS Start-End: 195-1292
atgcgcgatctcccggagcatgcgcagcagcggcgccgacgcggggcggtgcctggtgaccgcgcgcgctcccggaagtgtgccggcgtcgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaa

SEQ ID NO: 136928 - DNA, 792 bp, Homo sapiens
  Payload ID: 6808
  Gene Symbol: GTF3A
  Gene Name: general transcription factor IIIA
  ENST ID: ENST00000438571
  CDS Start-End: 63-377
tcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggaggtgaggggggcgaggctgccaaccctgggcctagggatggcgcgtggccccggggtagccactgcagtcgtggccagggccgcaggccccgctgtgcagcgcgttcagctttgacatccaggacttggggaaggagctgaggaagtagacaggaagttgtaggaccttcgttctgcgaccttgatatccatggcaggggctcgggatttactaagcagtcattgatcagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaagg

SEQ ID NO: 136929 - DNA, 1191 bp, Homo sapiens
  Payload ID: 6808
  Gene Symbol: GTF3A
  Gene Name: general transcription factor IIIA
  ENST ID: ENST00000419181
  CDS Start-End: 77-643
ccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaa

SEQ ID NO: 136930 - DNA, 1377 bp, Homo sapiens
  Payload ID: 6808
  Gene Symbol: GTF3A
  Gene Name: general transcription factor IIIA
  ENST ID: ENST00000439403
  CDS Start-End: 20-1288
atgcgcgatctcccggagcatgcgcagcagcggcgccgacgcggggcggtgcctggtgaccgcgcgcgctcccggaagtgtgccggcgtcgcgcgaaggttcagcagggagccgtgggccgggcgcgcggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctcttctcagtggatatatcctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcag

SEQ ID NO: 136931 - DNA, 688 bp, Homo sapiens
  Payload ID: 6808
  Gene Symbol: GTF3A
  Gene Name: general transcription factor IIIA
  ENST ID: ENST00000435781
  CDS Start-End: 101-505
gaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatattttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgt

SEQ ID NO: 136932 - DNA, 7018 bp, Homo sapiens
  Payload ID: 6809
  Gene Symbol: GTF3C1
  Gene Name: general transcription factor IIIC, polypeptide 1, alpha 220kDa
  Uniprot ID: Q12789
  ENST ID: ENST00000356183
  CDS Start-End: 17-6346
gccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctca

SEQ ID NO: 136933 - DNA, 7015 bp, Homo sapiens
  Payload ID: 6809
  Gene Symbol: GTF3C1
  Gene Name: general transcription factor IIIC, polypeptide 1, alpha 220kDa
  Uniprot ID: Q12789
  ENST ID: ENST00000561623
  CDS Start-End: 24-6278
gggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgca

SEQ ID NO: 136934 - DNA, 540 bp, Homo sapiens
  Payload ID: 6809
  Gene Symbol: GTF3C1
  Gene Name: general transcription factor IIIC, polypeptide 1, alpha 220kDa
  ENST ID: ENST00000568569
  CDS Start-End: 1-540
gaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaagtgtgtgtggcaggacttgtgccaagtgaggccagtggacaaggagaggctaccttttccgccaaggaggccacaggtttgtgccaacgagtttaaagaatttgtggagaagcttaaagaaaagttcagttcagccctaaggaattctaacct

SEQ ID NO: 136935 - DNA, 897 bp, Homo sapiens
  Payload ID: 6809
  Gene Symbol: GTF3C1
  Gene Name: general transcription factor IIIC, polypeptide 1, alpha 220kDa
  ENST ID: ENST00000569653
  CDS Start-End: 1-644
gcaggaatctgatcatagaagctgtcaccaatcttcgcttaatcgagagtttattcacgattcagaagatgatcatggatcaggagaagcaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactggg

SEQ ID NO: 136936 - DNA, 933 bp, Homo sapiens
  Payload ID: 6809
  Gene Symbol: GTF3C1
  Gene Name: general transcription factor IIIC, polypeptide 1, alpha 220kDa
  ENST ID: ENST00000564664
  CDS Start-End: 1-420
gcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggttatgtgaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataagtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctcc

SEQ ID NO: 136937 - DNA, 721 bp, Homo sapiens
  Payload ID: 6809
  Gene Symbol: GTF3C1
  Gene Name: general transcription factor IIIC, polypeptide 1, alpha 220kDa
  ENST ID: ENST00000571886
  CDS Start-End: 1-255
tttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggtgagtacctgtcaggagccttgggtactccgaggtggagccacgccctgtctgtaaagaggagcaaaggaagcactgtggccatgaaagcgtgtaggagccagggaccttcgcagcctcatgtgcaagatgccggcttgggtttcctgcagccccttacctccttcgtggtatggggatcaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaa

SEQ ID NO: 136938 - DNA, 3882 bp, Homo sapiens
  Payload ID: 6810
  Gene Symbol: GTF3C2
  Gene Name: general transcription factor IIIC, polypeptide 2, beta 110kDa
  Uniprot ID: Q8WUA4
  ENST ID: ENST00000264720
  CDS Start-End: 321-3056
ccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccatt

SEQ ID NO: 136939 - DNA, 3992 bp, Homo sapiens
  Payload ID: 6810
  Gene Symbol: GTF3C2
  Gene Name: general transcription factor IIIC, polypeptide 2, beta 110kDa
  Uniprot ID: Q8WUA4
  ENST ID: ENST00000359541
  CDS Start-End: 431-3166
ggtaacgcggaagcctgtgtccgggcgtaggcgctgcatacgtagcgtccctcgaactcggcgaacctacagtagtccttgttagaaaaaccagggctcctctcccgcacaggctaggggagaaatctaccttcacgcccaggactgaagaagggcaggtgatggcccctagagtggttgtgggtcaatctctttcagctgtgtcccagcctcttcctcgaggaggctctttaaccccgagggttgtgccccgcgcgctgcaacgccattggcgtaaccaagggccagttgtgtttccctgtctagtccttttgtcccgtggcaagttggctgcctgttggggaagtcagaggtggcgacttcaactccgtcggaggcaactcactttgttggagggatgtatagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccatt

SEQ ID NO: 136940 - DNA, 557 bp, Homo sapiens
  Payload ID: 6810
  Gene Symbol: GTF3C2
  Gene Name: general transcription factor IIIC, polypeptide 2, beta 110kDa
  ENST ID: ENST00000457748
  CDS Start-End: 154-557
cttagacttccggaaggactttggcgaggtccttttgtcccgtggcaagttggctgcctgttggggaagtcagaggtggcgacttcaactccgtcggaggcaactcactttgttggagggatgtatagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctct

SEQ ID NO: 136941 - DNA, 1440 bp, Homo sapiens
  Payload ID: 6810
  Gene Symbol: GTF3C2
  Gene Name: general transcription factor IIIC, polypeptide 2, beta 110kDa
  ENST ID: ENST00000454704
  CDS Start-End: 1-1262
cttttgcagtcttacagctgtactctttcagcacatttccttttatctcccccttcttccctcttctgtgctctcaagactttccccctcttgctgccacagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacag

SEQ ID NO: 136942 - DNA, 592 bp, Homo sapiens
  Payload ID: 6810
  Gene Symbol: GTF3C2
  Gene Name: general transcription factor IIIC, polypeptide 2, beta 110kDa
  ENST ID: ENST00000431028
  CDS Start-End: 1-239
cttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaa

SEQ ID NO: 136943 - DNA, 828 bp, Homo sapiens
  Payload ID: 6810
  Gene Symbol: GTF3C2
  Gene Name: general transcription factor IIIC, polypeptide 2, beta 110kDa
  ENST ID: ENST00000423998
  CDS Start-End: 605-828
agcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggagacaaagtcttgctgtgttgcccaggctgatcttgaactcctggcctcaagcgatcctcccaccttggcctcccaaagtgttgagattacaggcatgagccactgcgcccagcccagcacatgattcttgagccagcagctgtaaataagagcaccttcccagtttgataagcacttgttcctaccaactgtttttccctcaaccctcatcgtgatcatttatttatgcaagtgtttttcagcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaag

SEQ ID NO: 136944 - DNA, 762 bp, Homo sapiens
  Payload ID: 6810
  Gene Symbol: GTF3C2
  Gene Name: general transcription factor IIIC, polypeptide 2, beta 110kDa
  ENST ID: ENST00000457098
  CDS Start-End: 1-427
cgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaa

SEQ ID NO: 136945 - DNA, 779 bp, Homo sapiens
  Payload ID: 6810
  Gene Symbol: GTF3C2
  Gene Name: general transcription factor IIIC, polypeptide 2, beta 110kDa
  ENST ID: ENST00000415683
  CDS Start-End: 1-545
gctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttgtacgtatacgaacatctaacagcagctgttggatcctaacccacatgccctcccaaattctgctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattc

SEQ ID NO: 136946 - DNA, 1858 bp, Homo sapiens
  Payload ID: 6810
  Gene Symbol: GTF3C2
  Gene Name: general transcription factor IIIC, polypeptide 2, beta 110kDa
  ENST ID: ENST00000622534
  CDS Start-End: 79-1833
gagctagtacaaatagtttttgtcctctactcatttgtgtgtctctgtatgcaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggtaaaaaccaaaataaaacataaggaactattgctctttaaatttttt

SEQ ID NO: 136947 - DNA, 4282 bp, Homo sapiens
  Payload ID: 6811
  Gene Symbol: GTF3C3
  Gene Name: general transcription factor IIIC, polypeptide 3, 102kDa
  Uniprot ID: Q9Y5Q9
  ENST ID: ENST00000263956
  CDS Start-End: 91-2751
tgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaagtaaaaaactttttttttgtttgtttactcatctccactatttattatatgttcttgaatttaagttaacagtactttttagatgatatactgttagcttaataacaactttttagggaaaaataaatgctgtaattaatgtgcacatgggttagtaacacccagcccaattgtgggagggaaacaagtagaggcttaggatcaaagaaataaaattgggacttattagaaattcttaccactgtttctactgtacacaaaactttctagttgagcagaatttgtatgcaataagtaaatatattgtatactccatgtgtataatttaaatgcattttatttttataattgaggttaactgtttcacatgcttaatttttactttatgccatttataggtaatggtagaggtaactgagatacagtaataagttagacttgtgtgttggaattctgtggaactgagcattctgtgctccgagtttctctcttaaattagctcactggactgtggctccagtgtctactaaatagccgtggaggaaataagtctccctaagggaaaaaaaaaccagctgatattgtatagttttgtttagcttttaaaatcatagcttccatttgctgagtttttactctgctactgtatgctaagtatggtgctaaacactttggatatgttatctctgattctctcagggaactgcaaggtagttattattgatattgtcatcaccactttgtatctagagattaaatagcatgttcaagatcacta

SEQ ID NO: 136948 - DNA, 1736 bp, Homo sapiens
  Payload ID: 6811
  Gene Symbol: GTF3C3
  Gene Name: general transcription factor IIIC, polypeptide 3, 102kDa
  Uniprot ID: Q9Y5Q9
  ENST ID: ENST00000409364
  CDS Start-End: 49-1290
cggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatgtatgtaacaagatctgcacttgagatacttcagatcaaatgcaccatctcttttctttagatgtcaagaaattataacttgaccctagagtttcacatttcttaataaccaaggaggtaacaataagcatcaaataattttgtatgaatatcttataaaaactaaaattgttttgcaattgggcttacagtaatttatttttcttttaaaataacaatctaaagatcataatttgagattgtctttagaccatttgagattgtcattagataattggtaataattctgacagctattcttttttgcggactttggaccaagtatattattgaaaaaaaaaaagtacttagcatctactttgtaaaccttaggataagatattgagtaaaatatacaaatccataccctcatgggttgggatgcttttttgttttaatgggattagataataaaataaatacataacata

SEQ ID NO: 136949 - DNA, 547 bp, Homo sapiens
  Payload ID: 6811
  Gene Symbol: GTF3C3
  Gene Name: general transcription factor IIIC, polypeptide 3, 102kDa
  ENST ID: ENST00000455546
  CDS Start-End: 1-21
aagaaagtgaggcgatgctaggccacggtgcccttcactcttgttgccttcatacccttagggtagcttaacgctgagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatg

SEQ ID NO: 136950 - DNA, 326 bp, Homo sapiens
  Payload ID: 6811
  Gene Symbol: GTF3C3
  Gene Name: general transcription factor IIIC, polypeptide 3, 102kDa
  ENST ID: ENST00000416690
  CDS Start-End: 1-326
tgcaaatgctgcacagcaggaactgaagttattgcttcatcgttctactctgttgttttcacaaggcaaaatgtatggttatgtggataccttacttactatgttagccatgcttttaaagatggtactgtctagttgcaggaaaacaagctcagggctcccactgattctacattatgcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatg

SEQ ID NO: 136951 - DNA, 527 bp, Homo sapiens
  Payload ID: 6811
  Gene Symbol: GTF3C3
  Gene Name: general transcription factor IIIC, polypeptide 3, 102kDa
  ENST ID: ENST00000435252
  CDS Start-End: 1-447
agctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaaggtaataacttcatttgcattatgttatataaaatttggctgaattgaaaaagactcatgaagtaacactggacagcaatctaattgaaaatatacttttcaaataaaatgaaattttccaatctaaa

SEQ ID NO: 136952 - DNA, 1702 bp, Homo sapiens
  Payload ID: 6811
  Gene Symbol: GTF3C3
  Gene Name: general transcription factor IIIC, polypeptide 3, 102kDa
  ENST ID: ENST00000448087
  CDS Start-End: 1-486
gctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcaggtaacacttttttgtgggaggaagaagttttaatcatataagcagccaagaacttactttcccaagatggtaataattattatagtgcaagtgtttctggtttcaggggagttttttgaaagtcagtattttaaattgtcttgctaggctactaagtgatttccccatcactaatgctttggaggaatgatttacttaatgatgccagagtgaagttgaaggactcacatttcccttagatgcctgtcttgaacctctcttaaccatagggtctggtttctagcaaaggattgtcagacttggggcaaaatctaattttgaagagtttttatagatttatatttaatatgttatattgggaaaaattaatatatttttcaatgctctttgagccacacatactcaaaattgggttttatcagccgtttattacactgtgcctaagtccatagtaatctgcagtgaatcatttagactggaaaaaatagcttaagaaacatgactaaatcttttgaagaaatacatgaaagcaaaaagtattctaataggatttcttatagagtcaacataaaagatgcattaaaaatcgaatagtcttggtttcaaatactgtgtgatggcagaaaactctagtggctcttacatgaaagcaaaaagtattctaatagggtttcttattgagtcaacataaaagacgcattaaagatcgaatagtcttggtttcaaatactatgtgatggcagaaaactaatggctcttaagtattatatgatgacagaactctataattagagaagcattgattggcattttggggcagtagtgcactcacatcacagatatgagctaggaaagagagcacttaatgattaagataacacttttctgtttagatgaataaatatgaatacaaatgtaataccatcgtaaaaagctgcattatttgtgagatttgaattttaaagatatgagcaggatatcttagtttgtattgcctttctacttagggctgtgatattgaaactgctcctgtgttactaatagtgtatactttaaaaatcctatttaatcatgattctgatcaatgctgtttccattttgagcccatgtggcttgagatgaatgaaagataaaatctcagagtcatctaaaaatgataaagaaatttgggatcagtatataagaaagataattagaggaattcagttatttcagtaacaaaataacaaaatgtttttaaagtgaaaaatgagaaaa

SEQ ID NO: 136953 - DNA, 796 bp, Homo sapiens
  Payload ID: 6811
  Gene Symbol: GTF3C3
  Gene Name: general transcription factor IIIC, polypeptide 3, 102kDa
  ENST ID: ENST00000448539
  CDS Start-End: 115-231
agaaggacgccggttccttgctcttgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaagtgaggcgatgctaggccacggtgcccttcactcttgttgccttcatacccttaggtgtgggggacccagacgaccgctttcactgtgatggggcgggctgggaactttcagcagcttcttccttatcttacagaaactccggttttcacccctcatccctgtgctaagctccttaaaacgttttcccccaccgaaaagctttcgtcttggtggtaacctcttctttttcccccaatactacgtttttatttcagggtagcttaacgctgagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaag

SEQ ID NO: 136954 - DNA, 488 bp, Homo sapiens
  Payload ID: 6811
  Gene Symbol: GTF3C3
  Gene Name: general transcription factor IIIC, polypeptide 3, 102kDa
  ENST ID: ENST00000451088
  CDS Start-End: 1-134
agacagaccctgtaaacatgtcagggttcagtccggaactcatcgactacttggaagggaaaatctcctttgaggagttcgaacggcggagagaagagagaaaaacccgcgagaagaaagtgaggcgatgctaggccacggtgcccttcactcttgttgccttcatacccttagagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagtaaa

SEQ ID NO: 136955 - DNA, 9043 bp, Homo sapiens
  Payload ID: 6812
  Gene Symbol: GTF3C4
  Gene Name: general transcription factor IIIC, polypeptide 4, 90kDa
  Uniprot ID: Q9UKN8
  ENST ID: ENST00000372146
  CDS Start-End: 565-3033
cttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcggggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaatgccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagtgctattgccgcgctgcatgtaaagcacaggagcaaagattcgatacaattagaccctttaagctacaacgtggttgcatttggggagtctgatacccacataggtatcacattttctctgcctggggttaatttgttcttattattctaggtaagaaattgatagcttgttatgcttggtactcattctgaaatccctgtgtgtccaccaggcagacttcaagcaatctctacctactattatatctgccaaaactaccaattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcatcttttctctgcaacagttaaactgcctcagagtttgtgaattgctgcaattcctggaatggaaacaggaattagggtcactggttgattggcacaggatctttccatcgtttctgctcctgacctctctctcttgcctttccttcccccagacaccctcttggtttccattcctttagttccctctgctttagaacacagattacatgttggaaagaaaaatggattaatggtaaaatttctaaaagctaaattgtacagtggggtctcacttcctagaagaaactattggtaatatttctttctaaaggtaatagtattaattgtatctggttttcttcaaaacttaactataatttccttgtcagggtgctcagtagctcttggtttgactttgggctaagggatgtgaaattttagctccttcccaccacctgtttcccctcactcccacccccagccaatattcttcataagcaaaaattatggttaagctaagctgaatgggttatattcaaagtaagtacagacggcaaataggcagacaaatacaggaatgtctttacaattagcccaccatggactgttttgagtctctgcatggtttccataattcattatgatgtatctttatgctctttcactgctcttctgtgcgttggagtttagcaattcagtgagactggggagtgtctcaagaatggaacctttgccttcaaggttgggtcatcaaaaatccctctaaaggatctaactgtaatgaactgtttttatttttgccattagtgcaagtatcaactggcagcctcaaacagctttagactatgtctcaggtctctcatagttatacttagaactgctctttcttgaagctaaaagaggtttttggagtaaagatctgcttcatgtctgctagcatggtatctgctgttcaacctagtatagagcatgtgaaatgcaactgtcctttaatggaattcagccaaactccaaaaatactgagttgcttctagttatctaaagtagtacagaatcactatcccgatgaagaagtggggtttttcagaagattgtaaactcatttccatggcacagatacaaatcatcgtcaggacttgttagccagtccatgtctcattgataggatgtagcctgccatctgcatagatggtttaacatggtgctgtttttgaaaacttgctgtggaaataaatttgacagacgagtagttatttgtaaagctgtcctagaaagaggttaattcttttggtatatgaatatttctcctccaatccttttaattaggtggttcagcttatcttgtattttctgagtcataactatactctagggccaagacctactataaaatctggggtcctaaccagagagttgtttagatcaatatgatatgctttgccaacatgatctaagaaggtattcattctttctgggtttgagaagagttgacgaaagtgtaagattatactctcatgctaaaataaggtataggctaagtgaaatactgtaaatgggttggttagaattaaagtttagaactctaaatcttatgcttatttttaaagtaaaaagttgcctcactgtcatgaaatcctgttactttcattaaaaaaaaaaatcctgtaaaatggtcaaattggataatgtaagagataatgatggctttgaggcatttcatactttaccagtttacatttggctagcagactggtaaggtttagggttctctccactaatggaaaattaaatgctaaacgtcctaagaattatgttgttttcaaggctttgactcagatttgtactttgatgtatgaaagtgaatatcaaacttgtttatagaaaagactatatagaaaaataagtctgtgttgtgtatagtgatacatgttttatgtttacccaatgcctgtactaaatcttgtgcttggctttgaattatatatgtgtttacctatgacttttttttgaaataaacagaacagtcatctaaaaacataaggttttggaaaggagatgctttttcaattcttaccatctgattaggtggaatgttttatagacttttggtgttgaaaaaaaaaagtttgataacaatgcattttgcttggaataccccccaatccagaaaagttggtgacttctctccattgtatatatgtacatagttttcattactagattgtaagctcctcaagggcaggaattgttttatctttgttgttcctgcagcacctaatgtaaagtgccttgcacagggtaggtgctcatgacgtgtagaatgagtgagtaacttcctgcctcatcaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgtcctgcgtttttatctaatattagagctgaggttcctaggaaaattttgaagtggggaagattatggagaaaatgaaatggaaatttggggagggtggtttgtcagtataaggccctgtggggtaatcatattttagttattacttgttaaaagggtaacagaacctctgtttctttaccaagtcgctggttggccatttctccaattgatgaactaccattggttttagctctttctcatttgggattcccctcaattgcttacatgattctggtacttagagtctaatagagttgctgtgaatatgtagtgctgtacataatggcagttttgtaaatgtgagataaccttgaatatgttgtggtttgtatacagagccattagtattgttattttggccacttttttattcaaaataaataacataattatttgtata

SEQ ID NO: 136956 - DNA, 1417 bp, Homo sapiens
  Payload ID: 6812
  Gene Symbol: GTF3C4
  Gene Name: general transcription factor IIIC, polypeptide 4, 90kDa
  ENST ID: ENST00000483873
  CDS Start-End: 565-1014
cttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcggggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaa

SEQ ID NO: 136957 - DNA, 1905 bp, Homo sapiens
  Payload ID: 6813
  Gene Symbol: GTF3C5
  Gene Name: general transcription factor IIIC, polypeptide 5, 63kDa
  ENST ID: ENST00000342018
  CDS Start-End: 9-1382
gcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcacctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 136958 - DNA, 2406 bp, Homo sapiens
  Payload ID: 6813
  Gene Symbol: GTF3C5
  Gene Name: general transcription factor IIIC, polypeptide 5, 63kDa
  Uniprot ID: Q9Y5Q8
  ENST ID: ENST00000372097
  CDS Start-End: 324-1883
gaagtcgagggaggtttgtgtcttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 136959 - DNA, 1999 bp, Homo sapiens
  Payload ID: 6813
  Gene Symbol: GTF3C5
  Gene Name: general transcription factor IIIC, polypeptide 5, 63kDa
  ENST ID: ENST00000372099
  CDS Start-End: 441-1478
gattctcattggctgaagtcgagggaggtttgtgtcttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgag

SEQ ID NO: 136960 - DNA, 2110 bp, Homo sapiens
  Payload ID: 6813
  Gene Symbol: GTF3C5
  Gene Name: general transcription factor IIIC, polypeptide 5, 63kDa
  Uniprot ID: Q9Y5Q8
  ENST ID: ENST00000372108
  CDS Start-End: 9-1589
gcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgag

SEQ ID NO: 136961 - DNA, 920 bp, Homo sapiens
  Payload ID: 6813
  Gene Symbol: GTF3C5
  Gene Name: general transcription factor IIIC, polypeptide 5, 63kDa
  ENST ID: ENST00000440319
  CDS Start-End: 189-920
ttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcgatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatg

SEQ ID NO: 136962 - DNA, 823 bp, Homo sapiens
  Payload ID: 6813
  Gene Symbol: GTF3C5
  Gene Name: general transcription factor IIIC, polypeptide 5, 63kDa
  ENST ID: ENST00000439697
  CDS Start-End: 151-823
ggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctcc

SEQ ID NO: 136963 - DNA, 736 bp, Homo sapiens
  Payload ID: 6813
  Gene Symbol: GTF3C5
  Gene Name: general transcription factor IIIC, polypeptide 5, 63kDa
  ENST ID: ENST00000435745
  CDS Start-End: 1-272
gaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtgggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatca

SEQ ID NO: 136964 - DNA, 952 bp, Homo sapiens
  Payload ID: 6814
  Gene Symbol: GTF3C6
  Gene Name: general transcription factor IIIC, polypeptide 6, alpha 35kDa
  Uniprot ID: Q969F1
  ENST ID: ENST00000329970
  CDS Start-End: 211-852
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaata

SEQ ID NO: 136965 - DNA, 4193 bp, Homo sapiens
  Payload ID: 6815
  Gene Symbol: GPHN
  Gene Name: gephyrin
  Uniprot ID: Q9NQX3
  ENST ID: ENST00000315266
  CDS Start-End: 1122-3332
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattattt

SEQ ID NO: 136966 - DNA, 4297 bp, Homo sapiens
  Payload ID: 6815
  Gene Symbol: GPHN
  Gene Name: gephyrin
  Uniprot ID: Q9NQX3
  ENST ID: ENST00000478722
  CDS Start-End: 1122-3431
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 136967 - DNA, 2459 bp, Homo sapiens
  Payload ID: 6815
  Gene Symbol: GPHN
  Gene Name: gephyrin
  ENST ID: ENST00000543237
  CDS Start-End: 25-2373
agtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagagaaattcccaacattcccattttgtgggctccagaaaggggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaacaaattagacggccggatgaaagcaaaggagttgctagtagagttggatccctcaaagctcggcttccctcgtgctcatctacctatagtgtatctgaggtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttccc

SEQ ID NO: 136968 - DNA, 404 bp, Homo sapiens
  Payload ID: 6815
  Gene Symbol: GPHN
  Gene Name: gephyrin
  ENST ID: ENST00000556240
  CDS Start-End: 1-182
gattgttgatgctacctccaaagacagaacatgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatca

SEQ ID NO: 136969 - DNA, 841 bp, Homo sapiens
  Payload ID: 6815
  Gene Symbol: GPHN
  Gene Name: gephyrin
  ENST ID: ENST00000555456
  CDS Start-End: 1-841
gaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaacaaattagacggccggatgaaagcaaaggagttgctagtagagttggatccctcaaagtccagtccaggtgcagcagcaaggagaacattctcagagccagtcacagtgctgtcgatatcaccaaggtggctagaagacatcgcatgtctccttttcctctgacatctatggacaaag

SEQ ID NO: 136970 - DNA, 512 bp, Homo sapiens
  Payload ID: 6815
  Gene Symbol: GPHN
  Gene Name: gephyrin
  ENST ID: ENST00000556633
  CDS Start-End: 22-174
gcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaactt

SEQ ID NO: 136971 - DNA, 574 bp, Homo sapiens
  Payload ID: 6815
  Gene Symbol: GPHN
  Gene Name: gephyrin
  ENST ID: ENST00000553936
  CDS Start-End: 13-132
gcgctgggaaacatggcgaccgagggaatgatccttactaaccacgaccatcaaatccgtgtcggagtccttacagtagggatggagtttcaccgtgttagccaggatggtctcgatctcctgaccttgtgatccacccatctcggcctcccaaagtgctgggattacaggcgtgagccaccacgcccggccagcagtaaggtatttttaaattaagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctca

SEQ ID NO: 136972 - DNA, 503 bp, Homo sapiens
  Payload ID: 6815
  Gene Symbol: GPHN
  Gene Name: gephyrin
  ENST ID: ENST00000557654
  CDS Start-End: 13-162
gcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgggataaattccaaaactgccagtgaatggctgaaaccacagatactactgaacccaagtactgcgataccacaatagctgatctgataacccagatggctggttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctag

SEQ ID NO: 136973 - DNA, 550 bp, Homo sapiens
  Payload ID: 6815
  Gene Symbol: GPHN
  Gene Name: gephyrin
  ENST ID: ENST00000555668
  CDS Start-End: 22-171
gcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgggataaattccaaaactgccagtgaatggctgaaaccacagatactactgaacccaagtactgcgataccacaatagctgatctgataacccagatggctggttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagagaaattcccaacattcccattttgtgggctccagaaaggggccacaaaagaagtaatagaacgggaagcaccagggatggccctggcaatgctgatgggatcacttaatgttacacctctgggcatgctctcta

SEQ ID NO: 136974 - DNA, 655 bp, Homo sapiens
  Payload ID: 6815
  Gene Symbol: GPHN
  Gene Name: gephyrin
  ENST ID: ENST00000555503
  CDS Start-End: 1-606
cacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctatta

SEQ ID NO: 136975 - DNA, 1723 bp, Homo sapiens
  Payload ID: 6815
  Gene Symbol: GPHN
  Gene Name: gephyrin
  ENST ID: ENST00000459628
  CDS Start-End: 391-1533
gtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaagaaattcccaacattcccattttgtgggctccagaaaggggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagagtaaaatccatgaaactgccttttcattaaaaaaaggaaaaaaaaaaaaaaa

SEQ ID NO: 136976 - DNA, 2895 bp, Homo sapiens
  Payload ID: 6816
  Gene Symbol: GGPS1
  Gene Name: geranylgeranyl diphosphate synthase 1
  Uniprot ID: O95749
  ENST ID: ENST00000282841
  CDS Start-End: 233-1135
agtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataaaaa

SEQ ID NO: 136977 - DNA, 2740 bp, Homo sapiens
  Payload ID: 6816
  Gene Symbol: GGPS1
  Gene Name: geranylgeranyl diphosphate synthase 1
  Uniprot ID: O95749
  ENST ID: ENST00000358966
  CDS Start-End: 85-987
cgcgcaaatcctcgtccgcgagaactgcaaggcccgcaatgccctgcgcctgcgtggaccgattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagt

SEQ ID NO: 136978 - DNA, 1407 bp, Homo sapiens
  Payload ID: 6816
  Gene Symbol: GGPS1
  Gene Name: geranylgeranyl diphosphate synthase 1
  Uniprot ID: O95749
  ENST ID: ENST00000391855
  CDS Start-End: 301-1041
gtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagtt

SEQ ID NO: 136979 - DNA, 850 bp, Homo sapiens
  Payload ID: 6816
  Gene Symbol: GGPS1
  Gene Name: geranylgeranyl diphosphate synthase 1
  ENST ID: ENST00000471812
  CDS Start-End: 124-850
aaggctttctgggaaataaagtccatactctggggccaacgcgcaaatcctcgtccgcgagaactgcaaggcccgcaatgccctgcgcctgcgtggaccgattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagata

SEQ ID NO: 136980 - DNA, 868 bp, Homo sapiens
  Payload ID: 6816
  Gene Symbol: GGPS1
  Gene Name: geranylgeranyl diphosphate synthase 1
  ENST ID: ENST00000497327
  CDS Start-End: 179-868
tagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtg

SEQ ID NO: 136981 - DNA, 1396 bp, Homo sapiens
  Payload ID: 6816
  Gene Symbol: GGPS1
  Gene Name: geranylgeranyl diphosphate synthase 1
  Uniprot ID: O95749
  ENST ID: ENST00000488594
  CDS Start-End: 173-1075
aggccggccgggggccaccgaggggccaggagggcctgtgggccgcgggcaggaccggcccgccacagagcccctgcccacgtcccgttccgggctcagacccgacaagtgggagcgagatcaacatctggccccgccgcggggacaacattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttcca

SEQ ID NO: 136982 - DNA, 2390 bp, Homo sapiens
  Payload ID: 6817
  Gene Symbol: GSG1
  Gene Name: germ cell associated 1
  Uniprot ID: Q2KHT4
  ENST ID: ENST00000337630
  CDS Start-End: 69-1049
aaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccacccatctgattcctcaagaatctagacctagaaataccatttgacccagccatcccattactgggtagatacccaaaggattacaaatcatgctgctataaagacacatgcacacatatgtttattacggcactatttataatagcaaagacttggaaccaacccaaatgtccatcagtgatagactggattaagaaaatgtggcacatatacaccatggaatactatgcagccataaagaaggatgagtttatgccctttgtagggacatggatgaagctggaaaccatcattctgagcaaactatcgcaaggatagaaaaccaaacactgcatattctcactcacaggtgggaattgaacaataaaaacacttggacacagggtggggaacatcacacaccgggcctgtcatggggtggggggaggggggagggatagcattaggagatatactaacgtaaatgacgagttaatgggtgcagcacaccaacatggcacatgtatacatatgtaacaaatctgcacgttgtgcacatgtaccctagaactt

SEQ ID NO: 136983 - DNA, 1422 bp, Homo sapiens
  Payload ID: 6817
  Gene Symbol: GSG1
  Gene Name: germ cell associated 1
  ENST ID: ENST00000351606
  CDS Start-End: 134-1099
acacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaa

SEQ ID NO: 136984 - DNA, 1628 bp, Homo sapiens
  Payload ID: 6817
  Gene Symbol: GSG1
  Gene Name: germ cell associated 1
  Uniprot ID: Q2KHT4
  ENST ID: ENST00000396302
  CDS Start-End: 200-1057
aattattaaatgcccgtgttccctgtaaggcagcatttaatcatgaggcactccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctga

SEQ ID NO: 136985 - DNA, 1183 bp, Homo sapiens
  Payload ID: 6817
  Gene Symbol: GSG1
  Gene Name: germ cell associated 1
  Uniprot ID: Q2KHT4
  ENST ID: ENST00000457134
  CDS Start-End: 42-869
gcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgacctt

SEQ ID NO: 136986 - DNA, 1231 bp, Homo sapiens
  Payload ID: 6817
  Gene Symbol: GSG1
  Gene Name: germ cell associated 1
  Uniprot ID: Q2KHT4
  ENST ID: ENST00000432710
  CDS Start-End: 134-1153
acacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaaca

SEQ ID NO: 136987 - DNA, 832 bp, Homo sapiens
  Payload ID: 6817
  Gene Symbol: GSG1
  Gene Name: germ cell associated 1
  ENST ID: ENST00000542415
  CDS Start-End: 172-832
ctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagctaaaagcgagatggaagaggaattaaaaaaatgtgtgtatttacatttatatttattattgtgccacttagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtg

SEQ ID NO: 136988 - DNA, 702 bp, Homo sapiens
  Payload ID: 6817
  Gene Symbol: GSG1
  Gene Name: germ cell associated 1
  ENST ID: ENST00000545699
  CDS Start-End: 70-702
taaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagctaaaagcgagatggaagaggaattaaaaaaatgtgtgtatttacatttatatttattattgtgccacttagcactgctccatccccagtcctggaaacaatttagagcccttcggtccagtggtacagcggcagcaaaaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgt

SEQ ID NO: 136989 - DNA, 1028 bp, Homo sapiens
  Payload ID: 6817
  Gene Symbol: GSG1
  Gene Name: germ cell associated 1
  Uniprot ID: Q2KHT4
  ENST ID: ENST00000537302
  CDS Start-End: 56-952
ttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaa

SEQ ID NO: 136990 - DNA, 838 bp, Homo sapiens
  Payload ID: 6817
  Gene Symbol: GSG1
  Gene Name: germ cell associated 1
  ENST ID: ENST00000545401
  CDS Start-End: 131-838
caccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggc

SEQ ID NO: 136991 - DNA, 2797 bp, Homo sapiens
  Payload ID: 6818
  Gene Symbol: GSG2
  Gene Name: germ cell associated 2 (haspin)
  Uniprot ID: Q8TF76
  ENST ID: ENST00000325418
  CDS Start-End: 34-2430
gtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaa

SEQ ID NO: 136992 - DNA, 4191 bp, Homo sapiens
  Payload ID: 6819
  Gene Symbol: GMCL1
  Gene Name: germ cell-less, spermatogenesis associated 1
  Uniprot ID: Q96IK5
  ENST ID: ENST00000282570
  CDS Start-End: 252-1799
atgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaa

SEQ ID NO: 136993 - DNA, 3336 bp, Homo sapiens
  Payload ID: 6820
  Gene Symbol: GCSAM
  Gene Name: germinal center-associated, signaling and motility
  Uniprot ID: Q8N6F7
  ENST ID: ENST00000308910
  CDS Start-End: 186-722
ctctaacactcctcccccagcctcttccttccctctgcagagacacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaatattaaatcacaaatggataagtgagaccaaggcaatttagcaaattctactatttctgtattcacacctgtgtcttccacttgctgttttatttaactcacggctactgtcctaattttagggatgctaaaatagtttgttttaaaagaggtttgtttaagaaagcagtaggtacattatgtttactagacaggcccttggaccagctaagcgacagggaacctggtacattatgtttagttactgttttcttctcaaagttaaccaaagctaaataactttcctatgtaaaatgtgctgactcccaaaagaggagaaatgcaatggcttgagcttgcatgtgtcacaggtttgtggagccttcagccaggtgatggtcttcagctaaagagccagctgcatcttggtatctcttcctctgctaacttcctacttttagcaaaattctttcacttggaactctagctgatccttggccaggatcagatcctcaaaaggaaatattcagttagcagtggatattgtacaagatgtaacatggcttagaggaaagagtgtagacccagcgacagatcatcagtcactcaaatcctggttctctctcttcctccatctgtgactttgaacatgctacttggaggctcagcttcttcaccatcaacaggaggattacatctaatgcaggcaatcatctattacagatgccgaataaatgatatcaaagagcatagagaaacaaaaatcttttatgatgtacggaaaaaaaccatgctgatacagctggctattcagggtcacccagcagtcctccagcaaggtagaaacaccaaatcaatgagtttatgctagaatttttcacatggccactggaccattgtggaagtagactggttgaaatattcttagtatgacatagtaagttatatttgtttgaaccttatcctgtgaaagcattatctgtcccaaacagtatatgccttttatcagggacacattaaatataaatgtttaaccaaagaaagttgttcttataatgtaattataacagggatttataagagggaattataagagggattatgaaagggaattacttttgagcaaggggagccatttgggagtgcttcaagatacccaatatgatatacacaattatgatttgtcagtcaaaaataatattaagaacaaaaaaagagttaaaaaattctgatatgagtgtaatatacttaatatgtaggatgtctcaaatttccagtaaataaattttaatgtcccaaaa

SEQ ID NO: 136994 - DNA, 1072 bp, Homo sapiens
  Payload ID: 6820
  Gene Symbol: GCSAM
  Gene Name: germinal center-associated, signaling and motility
  ENST ID: ENST00000470085
  CDS Start-End: 139-282
cttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccaggaagacaaaggcattctaccatgagagatgtgtccaagttatctagaatgaaacacgcttgcggggagaaaaaaagttttccacagaaatggcaaaaggaaaggagtcaccttaacaaagctgcagaaatcaaccttatgatttgccatctctcttgggtattttagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctt

SEQ ID NO: 136995 - DNA, 871 bp, Homo sapiens
  Payload ID: 6820
  Gene Symbol: GCSAM
  Gene Name: germinal center-associated, signaling and motility
  ENST ID: ENST00000495418
  CDS Start-End: 47-190
ggaagtggtaaagggacggaggggaagccctgagaggactgagaggatgggaaattctctgctgagagaaaacaggcggcagcagaacactcaagagatgccttggaatgtgagaatgcaaagccccaaacagagaacatccaggaagacaaaggcattctaccatgagagatgtgtccaagttatctagaatgaaacacgcttgcggggagaaaaaaagttttccacagaaatggcaaaaggaaaggagtcaccttaacaaagctgcagaaatcaaccttatgatttgccatctctcttgggtattttagatgctgggatcaccatatcgctgaagggtgtttctgccttccatggaaaaaaatactcatttttgaaaagaggcaagattcccaaaacgaaagacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagcc

SEQ ID NO: 136996 - DNA, 809 bp, Homo sapiens
  Payload ID: 6820
  Gene Symbol: GCSAM
  Gene Name: germinal center-associated, signaling and motility
  ENST ID: ENST00000487901
  CDS Start-End: 476-809
tgcagagacacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggttttgccttctcccaagaatcatggtgagcagctgatggagaatagctgaaaggtggaaagactttaccaaggaaggtctatataataggttaccacctaagaaatgaaacaactttctgaaagcccgggaaggagatgctctcctgagctcctcatgctccacaaggaggtcaaaatcaccaccctctttcagccactattttaagtttgaaataaacagcaagcttcctgccaccttgagtcttcctttgatgtgcactccctgcaagcaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtatt

SEQ ID NO: 136997 - DNA, 1036 bp, Homo sapiens
  Payload ID: 6820
  Gene Symbol: GCSAM
  Gene Name: germinal center-associated, signaling and motility
  Uniprot ID: Q8N6F7
  ENST ID: ENST00000484193
  CDS Start-End: 135-677
tcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacagtttcaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctc

SEQ ID NO: 136998 - DNA, 816 bp, Homo sapiens
  Payload ID: 6820
  Gene Symbol: GCSAM
  Gene Name: germinal center-associated, signaling and motility
  ENST ID: ENST00000488580
  CDS Start-End: 437-816
agagccacacagccctttctttaagtcaggagttgccctgtcagagcacaaggcaagaaggaagtggtaaagggacggaggggaagccctgagaggactgagaggatgggaaattctctgctgagagaaaacaggttttgccttctcccaagaatcatggtgagcagctgatggagaatagctgaaaggtggaaagactttaccaaggaaggtctatataataggttaccacctaagaaatgaaacaactttctgaaagcccgggaaggagatgctctcctgagctcctcatgctccacaaggaggtcaaaatcaccaccctctttcagccactattttaagtttgaaataaacagcaagcttcctgccaccttgagtcttcctttgatgtgcactccctgcaagcagtttcaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatcccc

SEQ ID NO: 136999 - DNA, 623 bp, Homo sapiens
  Payload ID: 6820
  Gene Symbol: GCSAM
  Gene Name: germinal center-associated, signaling and motility
  Uniprot ID: Q8N6F7
  ENST ID: ENST00000460387
  CDS Start-End: 132-623
tttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccaggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatag

SEQ ID NO: 137000 - DNA, 3820 bp, Homo sapiens
  Payload ID: 6821
  Gene Symbol: GCSAML
  Gene Name: germinal center-associated, signaling and motility-like
  Uniprot ID: Q5JQS6
  ENST ID: ENST00000366488
  CDS Start-End: 105-512
agatgcaacgtcctgcctcatgcattttcctcttggtgctttggtcagaacttccccaagtggagtgaaactcaggagctgagaaaccgagtcactgtgaaaagatgggaaattatctcctgcgaaaactcagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttgaa

SEQ ID NO: 137001 - DNA, 4030 bp, Homo sapiens
  Payload ID: 6821
  Gene Symbol: GCSAML
  Gene Name: germinal center-associated, signaling and motility-like
  Uniprot ID: Q5JQS6
  ENST ID: ENST00000366489
  CDS Start-End: 377-724
agacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgaggcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttg

SEQ ID NO: 137002 - DNA, 4130 bp, Homo sapiens
  Payload ID: 6821
  Gene Symbol: GCSAML
  Gene Name: germinal center-associated, signaling and motility-like
  Uniprot ID: Q5JQS6
  ENST ID: ENST00000366491
  CDS Start-End: 498-845
acaagagacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagaggaaaggccagatgaggacacagcaagcaggcagatggctgcgagctggaagggaagcgtcatcagaaaccaaccctgagggtaccttgatcttggacttccagtctccagaactgcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatg

SEQ ID NO: 137003 - DNA, 1308 bp, Homo sapiens
  Payload ID: 6821
  Gene Symbol: GCSAML
  Gene Name: germinal center-associated, signaling and motility-like
  ENST ID: ENST00000527084
  CDS Start-End: 359-670
tttccctttgataccctctgtttgtaacaatcccaatgccaacactgtcctgtttctacaagagacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttctta

SEQ ID NO: 137004 - DNA, 562 bp, Homo sapiens
  Payload ID: 6821
  Gene Symbol: GCSAML
  Gene Name: germinal center-associated, signaling and motility-like
  ENST ID: ENST00000529512
  CDS Start-End: 340-562
tttccacggtgacgccgtctgcactagcgccgcacccgcttcaactgcctgcaaccgccgctgaattccctcatccccacgctgagaggacgagaaaggcgccctggggaaggctctcgggaaagcccgcagccgctggacgcgggaggacatggaggatttactgcctcaagatggttatgttggaggattccaatagttctactggatgtggagccagaaattgtgtggaatgcctggtgtttctttcagttcttggatgccaatctgagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcag

SEQ ID NO: 137005 - DNA, 1822 bp, Homo sapiens
  Payload ID: 6821
  Gene Symbol: GCSAML
  Gene Name: germinal center-associated, signaling and motility-like
  ENST ID: ENST00000463359
  CDS Start-End: 245-556
ttcccgcgcggctgccgccctttccacggtgacgccgtctgcactagcgccgcacccgcttcaactgcctgcaaccgccgctgaattccctcatccccacgctgagaggacgagaaaggcgccctggggaaggctctcgggaaagcccgcagccgctggacgcgggaggacatggagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcata

SEQ ID NO: 137006 - DNA, 1094 bp, Homo sapiens
  Payload ID: 6821
  Gene Symbol: GCSAML
  Gene Name: germinal center-associated, signaling and motility-like
  ENST ID: ENST00000527541
  CDS Start-End: 284-595
ctctgtttgtaacaatcccaatgccaacactgtcctgtttctacaagagacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgaggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagt

SEQ ID NO: 137007 - DNA, 522 bp, Homo sapiens
  Payload ID: 6821
  Gene Symbol: GCSAML
  Gene Name: germinal center-associated, signaling and motility-like
  ENST ID: ENST00000526896
  CDS Start-End: 282-522
aatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagaacttccccaagtggagtgaaactcaggagctgagaaaccgagtcactgtgaaaagatgggaaattatctcctgcgaaaactcagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcct

SEQ ID NO: 137008 - DNA, 4063 bp, Homo sapiens
  Payload ID: 6821
  Gene Symbol: GCSAML
  Gene Name: germinal center-associated, signaling and motility-like
  Uniprot ID: Q5JQS6
  ENST ID: ENST00000536561
  CDS Start-End: 348-755
tttccctttgataccctctgtttgtaacaatcccaatgccaacactgtcctgtttctacaagagacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagaacttccccaagtggagtgaaactcaggagctgagaaaccgagtcactgtgaaaagatgggaaattatctcctgcgaaaactcagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttgaa

SEQ ID NO: 137009 - DNA, 3959 bp, Homo sapiens
  Payload ID: 6821
  Gene Symbol: GCSAML
  Gene Name: germinal center-associated, signaling and motility-like
  ENST ID: ENST00000623578
  CDS Start-End: 340-651
tttccacggtgacgccgtctgcactagcgccgcacccgcttcaactgcctgcaaccgccgctgaattccctcatccccacgctgagaggacgagaaaggcgccctggggaaggctctcgggaaagcccgcagccgctggacgcgggaggacatggaggatttactgcctcaagatggttatgttggaggattccaatagttctactggatgtggagccagaaattgtgtggaatgcctggtgtttctttcagttcttggatgccaatctgagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttgaa

SEQ ID NO: 137010 - DNA, 2650 bp, Homo sapiens
  Payload ID: 6822
  Gene Symbol: GHDC
  Gene Name: GH3 domain containing
  Uniprot ID: Q8N2G8
  ENST ID: ENST00000301671
  CDS Start-End: 443-2035
cttttctttttttttttgacagggtctcactctgttgcccaagctggggtgcagtggcacgatcttggctcactgtagccttgacatcctgggctcaagggatcctcccatctcagcctcccaagtagctgcgactatgggtgtgacaccacgctgggctagtttttcaattttttgtagagatggagtctccctatgttgctcaggccggttgcaaactcctgggctcaagtgattctcctgcctcagcctcccaaagtgctgggattacagatgatagccacctcacccggcccacccctaccttctgaaagaggcattcttattcttattcccattttgcagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccag

SEQ ID NO: 137011 - DNA, 2496 bp, Homo sapiens
  Payload ID: 6822
  Gene Symbol: GHDC
  Gene Name: GH3 domain containing
  Uniprot ID: Q8N2G8
  ENST ID: ENST00000414034
  CDS Start-End: 200-1624
aaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccag

SEQ ID NO: 137012 - DNA, 2518 bp, Homo sapiens
  Payload ID: 6822
  Gene Symbol: GHDC
  Gene Name: GH3 domain containing
  Uniprot ID: Q8N2G8
  ENST ID: ENST00000428494
  CDS Start-End: 224-1648
cctggtggccggatttcccagttggggcccagccttttaaagccatcgctccttctttctggccggatgtgtgctgagacccagagtcacccaggggtctccgtcacgtgccaggagtaggcagaagtgggctgtgacaggtgcatgtgggcatggaccccacagcctggggctcaggagggacaaggagctgggacaggctcttcccaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcaccc

SEQ ID NO: 137013 - DNA, 842 bp, Homo sapiens
  Payload ID: 6822
  Gene Symbol: GHDC
  Gene Name: GH3 domain containing
  ENST ID: ENST00000588762
  CDS Start-End: 184-522
ctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagggtctcaccagtcttgcctgaaactcttgggaaactggcttcctgaggcgtttctgttgtcattggggctatagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctg

SEQ ID NO: 137014 - DNA, 561 bp, Homo sapiens
  Payload ID: 6822
  Gene Symbol: GHDC
  Gene Name: GH3 domain containing
  ENST ID: ENST00000590249
  CDS Start-End: 124-561
agccttttaaagccatcgctccttctttctggccggatgtgtgctgagacccagagtcacccaggggtctccgtcacgtgccaggagtaggcagaagtgggctgtgacaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctg

SEQ ID NO: 137015 - DNA, 2396 bp, Homo sapiens
  Payload ID: 6822
  Gene Symbol: GHDC
  Gene Name: GH3 domain containing
  Uniprot ID: Q8N2G8
  ENST ID: ENST00000587427
  CDS Start-End: 190-1782
ctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcaccca

SEQ ID NO: 137016 - DNA, 559 bp, Homo sapiens
  Payload ID: 6822
  Gene Symbol: GHDC
  Gene Name: GH3 domain containing
  ENST ID: ENST00000588352
  CDS Start-End: 169-559
tcgctccttctttctggccggatgtgtgctgagacccagagtcacccaggggtctccgtcacgtgccaggaatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggcca

SEQ ID NO: 137017 - DNA, 1827 bp, Homo sapiens
  Payload ID: 6822
  Gene Symbol: GHDC
  Gene Name: GH3 domain containing
  ENST ID: ENST00000593209
  CDS Start-End: 165-1604
ctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagattcttgcctcagggtctgctttggggaaacgggagtggaccccggcccagccattcccccactgagctccaggactttcccccaacattctgctctgggcctggcaaggctgcatgcgcacacaggagccttggaggactcgtggcacatcctaggccagcacccacaaaccacttctgcggtggggaagggagagctattacttcacatcataaggcatcgccgcaggaagcaactccggagaccatctgggttcactgttccatactaatgaggaaacgcagcctc

SEQ ID NO: 137018 - DNA, 1313 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000287656
  CDS Start-End: 842-1192
gtggatgtttacttgctggtggtcttatctaagatcaacattggcagctgtgcccggagaggcctccagggtccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137019 - DNA, 1425 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000335542
  CDS Start-End: 872-1225
agttccccaaagataacacagctttgcacagtggatgtttacttgctggtggtcttatctaagatcaacattggcagctgtgcccggagaggcctccagggtccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtatgctgatgttccaaatgggaatttatttcaaagaggaaaagttaatattttactttaaaaaaatcaaaataatac

SEQ ID NO: 137020 - DNA, 440 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000449238
  CDS Start-End: 5-319
gtggatgtttacttgctggtggtcttatctaagatcaacattggcagctgtgcccggagaggcctccagggtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137021 - DNA, 855 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000457360
  CDS Start-End: 381-734
gtggatgtttacttgctggtggtcttatctaagatcaacattggcagctgtgcccggagaggcctccagggtccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137022 - DNA, 217 bp, Homo sapiens
  Payload ID: 6823
  Gene Symbol: GHRL
  Gene Name: ghrelin/obestatin prepropeptide
  ENST ID: ENST00000446937
  CDS Start-End: 5-127
gtggatgtttacttgctggtggtcttatctaagatcaacattggcagctgtgcccggagaggcctccagggtccagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137023 - DNA, 856 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000430179
  CDS Start-End: 381-731
gtggatgtttacttgctggtggtcttatctaagatcaacattggcagctgtgcccggagaggcctccagggtccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgta

SEQ ID NO: 137024 - DNA, 326 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000439975
  CDS Start-End: 5-205
gtggatgtttacttgctggtggtcttatctaagatcaacattggcagctgtgcccggagaggcctccagggtccagttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137025 - DNA, 227 bp, Homo sapiens
  Payload ID: 6823
  Gene Symbol: GHRL
  Gene Name: ghrelin/obestatin prepropeptide
  ENST ID: ENST00000425479
  CDS Start-End: 127-227
aagataacacagctttgcacagtggatgtttacttgctggtggtcttatctaagatcaacattggcagctgtgcccggagaggcctccagggtccaggcccacctgtctgcaacccagctgaggccatgccctccccagggaccgtctgcagcctcctgctcctcggcatgctctggctggacttggccatggcaggctccagcttcctgagccctgaacaccagag

SEQ ID NO: 137026 - DNA, 401 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000422159
  CDS Start-End: 33-308
caggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgt

SEQ ID NO: 137027 - DNA, 793 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000429122
  CDS Start-End: 319-672
aacacagctttgcacagtggatgtttacttgctggtggtcttatctaagatcaacattggcagctgtgcccggagaggcctccagggtccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137028 - DNA, 443 bp, Homo sapiens
  Payload ID: 6823
  Gene Symbol: GHRL
  Gene Name: ghrelin/obestatin prepropeptide
  Uniprot ID: Q9UBU3
  ENST ID: ENST00000437422
  CDS Start-End: 5-322
gtggatgtttacttgctggtggtcttatctaagatcaacattggcagctgtgcccggagaggcctccagggtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 137029 - DNA, 4237 bp, Homo sapiens
  Payload ID: 6824
  Gene Symbol: GID4
  Gene Name: GID complex subunit 4 homolog
  Uniprot ID: Q8IVV7
  ENST ID: ENST00000268719
  CDS Start-End: 174-1076
agcgggccgctcgcgcaccgcgccacgtgttttctcctcccgccaatgggcggaagcgccgcctgagcctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacggggaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaataagagtttttttattacaaaattatttttatggtccctttaacgaggaccctatggcaaatgcacaattattcagaattacattttatcgttttcacattgaaaacagcaaatgttgacttagtaatttttatatcgatatctatatgtatatgtatatttaatcaaccagcagttttgaaactagtcatcctggtacaaaagttttgcagcattgcctaaattatagtgctcaacacaagaactgtttttggggccagtttagcatttgtgccgcctccttttgctactcaaaacagcaatgcttggcggcagccttccatgaggcagaaggggtcgtcgttctctgaaaacagtgactctgaaatgttgggacaggggaaggggtgggaaacatgaacatgctcaaataactcgaggctcacgtgccaaagtgtgtgtgtgtgtgtgtgtgtgtgtgtgtgtgtatgatgttttgtttttttaaatgttttaaaagcttaataggttggcatcagttgtagcccacaaacatggctagggctttggggatttggcatttttctggtggtttacaagacttactccgaatacaagaggaaaagctttaaaaacaagattgcatcataacccccaggagcaaagcaacctggaggctgcatatccatgggcgggcagcataagagaatgtgaagcccttcagtgagacgagacgagcaatgggaaaccttttctgttcttaagaagtgactttaattttattgacatatgtactgtatgttactgagattgaatgttaggggaagccttaaggtagaggtatttgggaaagtagccagtgggcacttgtgatatctaaaatctgttatcccaggactgtgtacagaggggcaacctacccattcaggaaggtcagggctttggaaccctaaaaagttggcccgatgacttaaagggaaaaataattcattcccagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccggaggtcatccctgagctcatccacggctcatgctgtggctccgagtagtggtttgagtgggcaggaagggccatttgcaaacactgctgtgttctagacaaacaacccaagtcctatggcaggatttcttccttccttccttttttacccaggtgatgaagtgcacccattgtactgggaagaatgaagaggtgatacctttactagatccttcagacacatctatgagaagatttgttcatttaaaagtctgcccactgaggatagggaaaggattaaggatttttccacctcctcttagtaactcctgaattaccaacatcaacttctttctctccgttcctgaaggaactttggggaatcatcttcatccgtagttacgctttcctgaaccttctcagtggtttacatgcctctgaaactatgtgcaatatttttggttgacacttgtatccatccttaagaaattagtgcagattgcagatgttctgtcttccatcccaaacaagcctgccatgaggtaggatcctaggggtttggctgttcttactccactgctcagaaagcttccattctgctgtcctcagcctcgaccctcttctgtgctggacttccacccacccacccttttcaagtttagatagtgtttcagctgctgtcccaaagtaacaaaacaatacctactgttaagtaggaagtcaatctgtgtgctggttttgttggttatgtggaaatcacaaactccagaggagcaaaggggtttttcaatgtcttttgctttcagaaacagagaatataatattctcactaaggccttgaattgatttttttctcataaaatagtctgataagctaatttttaaaaagaaatgccattaactgtgttgtatcgtggtttaaaattactaacaagttgtgggaaagaaaaataatatttgattttgaatcttaaatgtttttaaaaattagacttgaatgggcacaaagtataaatattttgtttctttatggaggacatgtggaaggagtttgagggtttgggatgggagaagtattttgcagagctatcaatgtccaaataatttaaaaaaaaaaataaaggtatttaagcagtg

SEQ ID NO: 137030 - DNA, 1391 bp, Homo sapiens
  Payload ID: 6824
  Gene Symbol: GID4
  Gene Name: GID complex subunit 4 homolog
  ENST ID: ENST00000376345
  CDS Start-End: 21-950
gtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacggggaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggaacattggaagatatctggatctgcagactctgctagactggactgaaacattttgggtgagagaggaactaagaaggccacccttggtactggcatgtgaggtgtggttgagccagggagctgaacctatggagtgcttcctcctccaacagtttgtggctgcttttgtagtactcagcatttcccctaactttcaccactcatggaggactcccaggttcccacgtgggactcctggagctctgtactgcacctgggtttgtctgagatttacaatgtctaatacacttcacctaggctgtcattttttcattataaactagaatcagagatattgtattgcatcctcagattttcctgagtggtatttaagttgctattatagtggtactataaagtcaggattccatatattcagtctacataggataaaaatgtctatgtgacaccaggtgtggtggctcatgcctgtaatgccagcactttgggaggccgaggcagatggatcacctgaggtcaggagttcgagaacagcctggccaacatggtgaaaccccatctctaccaaaaatataaaaattaaccaggcatggtggcacacacctgtaatcccagctattcgggaggctgaggcaggagagtcacttgaacctgggaggcggagattgcagtgagctgagatcatgccattgcactccagcctgagcaacaagagcaagactttgtctcaaaaaataataataaaataaatctatgtgacaaaa

SEQ ID NO: 137031 - DNA, 540 bp, Homo sapiens
  Payload ID: 6824
  Gene Symbol: GID4
  Gene Name: GID complex subunit 4 homolog
  ENST ID: ENST00000459843
  CDS Start-End: 1-336
acccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtgaggacctctgaggacagaggccacggggagggcttgctgcccagctggctctcccttggctcatcaaacccaaaagcaacatcttagcctgtctctgtatagattctgtgctttatttggatgctgagagcttatttcagtgatctcagttgctcacaataaggccttatccctatgcacagagcagagtaaatgagatgaaaat

SEQ ID NO: 137032 - DNA, 481 bp, Homo sapiens
  Payload ID: 6824
  Gene Symbol: GID4
  Gene Name: GID complex subunit 4 homolog
  ENST ID: ENST00000481836
  CDS Start-End: 1-441
ttcttcgaaggagaaataatcagcaaaaaacaccctttcttaactcgcaagtgggatgcagatgaagatgttgatcggaaacactggaacattggaagatatctggatctgcagactctgctagactggactgaaacattttggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggc

SEQ ID NO: 137033 - DNA, 4397 bp, Homo sapiens
  Payload ID: 6825
  Gene Symbol: GID8
  Gene Name: GID complex subunit 8
  Uniprot ID: Q9NWU2
  ENST ID: ENST00000266069
  CDS Start-End: 148-834
ccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 137034 - DNA, 15244 bp, Homo sapiens
  Payload ID: 6826
  Gene Symbol: GAN
  Gene Name: gigaxonin
  Uniprot ID: Q9H2C0
  ENST ID: ENST00000568107
  CDS Start-End: 163-1956
agcgcgccgcggatagcacaggcacgtcccgggggctccagcttctgctcagagcgcggagagccgggccgggcgggcgcgcgcgcaggactcgggccgctcgaggggtccggccggacggtgtcgggagccggacccgtcggcagaggagcgggcgccgcgatggctgagggcagtgccgtgtctgaccctcagcacgccgcgcgtctgctgcgagcgctcagctctttccgcgaggagtctcgcttctgcgacgcgcacctggtcctcgacggggaggagatcccggtgcagaagaacatcctggcggcggccagcccgtacatcaggacaaagttaaactataatcctccaaaagatgatggatcaacttataagattgaacttgaagggatatcggtaatggttatgagagagatcctggattacatcttcagtgggcagatcaggctaaatgaagatacaatccaagatgttgttcaggcagctgacctgctgctactgacggaccttaaaaccctgtgctgtgagtttttggaaggctgcattgctgctgagaactgtattggtatccgtgactttgcactacattactgcctccatcacgttcattaccttgccacagaatacctggagactcatttccgagacgtcagcagcacggaagaattcttagagctgagtcctcaaaagcttaaagaagtgatttctcttgagaagttaaacgttggcaatgaaagatatgtctttgaagcagtaattcgatggatagcacatgatacagaaataagaaaggtccacatgaaggatgttatgtcagctctgtgggtttcagggttggactccagttatttacgggaacagatgctgaatgaaccattagtacgagaaattgtcaaagagtgtagcaatataccgctcagccagccgcagcaaggggaggcgatgctggccaacttcaaaccccggggctactctgagtgcatcgtgactgttggtggagaagagagagtttcacggaaacccacagcagcgatgcgatgcatgtgccctctctatgaccctaacaggcagctttggatcgaactggcccctttaagcatgccgagaattaaccatggagttctctcagcagaaggatttttgtttgtattcgggggccaagatgaaaataagcagactcttagctcaggagaaaagtatgatccagatgcaaatacatggacagcattgccacctatgaacgaggcaagacataacttcggaattgtggagatagatgggatgctgtacattttgggaggagaggatggtgaaaaggagctgatttccatggagtgttacgatatttattctaaaacctggacaaagcaacctgatttgaccatggtcagaaagatcggctgctatgcagctatgaaaaagaaaatctacgccatgggtggaggctcctacggaaagctttttgagtctgtagagtgttatgatcccaggacccagcagtggactgccatatgtccactaaaagagaggaggtttggagcggtggcctgtggagttgctatggagctgtatgtgtttgggggagtccgaagtcgtgaggacgcccagggtagcgagatggtaacttgcaagtccgagttctaccatgatgagtttaaaaggtggatctatcttaacgaccagaatttatgcatccccgccagttcctcttttgtttatggagctgtacctataggagccagtatttatgttattggagatcttgatacaggtaccaattacgactacgtgcgtgagtttaaaagaagcacaggaacctggcaccacactaaaccactccttccatccgaccttcgccgtacaggatgtgcagccttacgcattgcgaattgcaagcttttccgcctgcagcttcagcaaggcttattccgtattcgtgttcattccccttgaggaggaagcagagcagagtgcgagatcctgacccaagagcaccataacatagctccgaaagggagagcagagatggcagctgaaactcactctgtgctgggctttggtatggtaactctttggtggttttatgatgcttacaaacttgagctttagctcttgtttgggagaacacgtaactgttgaaaaactacctgggaggagtgagttcctccagttaaatgtggctgtagatgttggaggctagggaggctagtaaatatcaaaaggaaaagggagtgggaattgctatcatgtaaaatatcaaagttaaaatactaaggtgcattttccctgaagggaactcatgtctgactgctgtattcaaatacgtagctttggtaacaaacaaaatccgtatatgcaaatcaacatatccaaacatgccaagactgcttttccactgcacttggaaggatatattatgcctaaccctgcccaacaaattaaggtttgtgcctaaaatgttagattggactgtatgccagttagtctccatttattcctagtactctgtcctaagaatctttttaaaactatatcatgatgaattgaaatgaagataaaattgctcttttgtaactttatcttagtaatgtaaagattcagtaaattgatgagtcaggttgcagccctcatgtgaactgaaagaagttgctcgcttctgtgttgacttagatcaagacacgtcacgcatcctttctggggtagtacctgtggagccgggaagggtctcctgcagtgccattctgccttctcaatgagcaaaaccattttctaagtatgaggatattagtgagtaggagattttataaaagaaagacctgagtcagacaaataataaaggtctgctgtggctaaaaaagcaaaaacaaaaaagctatccagacaaaatacatagggatcagaaactttttcatataacctgtctgaaagcacacaaagtcttgtttactactgtttagggtttgaaaacttgtcttagaatgcgaatctgtgttaagaatctagtctttgtaatagaagtttcccagtggcattcactagtgagagttttagacaaattatgttacgagtaaagtttggctggtagaataaactacctcaacttaatttcattctgttcatagtagagcaaattaatcttttcctccttccctcctttcctatctctcattctcacctcaacccactttaccccacttctcattgggggaaaaatgtctttcgttcgtggaacgtatcttgtaagatattttgttttccacttgaattacaccaccctagtgtgaaatcggggacttcaaagtgcttgattccttcctaaattgaattttatgcaatgtcaaatttctaatcaatttaatatacagtacttcatttttaattgttttctaaaaaaaaggttttttttttccttttggaatatggctgtaagaagcagcattttgtcttattaacacatgtataaaggtatcctttggttttaagtcgagaacaggaatttcttctagaaacttcctgtatggaacgtttatatgcaattaacatgcatatgaaaaacatcacttacgttctcccacccatagacataaaaaagggtgacctgtgattttttttcttatacctgctggaagtcagtacaatgcgtcaaaagttgctgaaagatgctgtgcctatggggttctagagagtgttgagtgtggtacattaactctccattttagccagaagatacctgataagagaaggtgtaaggtttttatcttatatgccagaggcaccaggccagatgtgccgcacagtcatgtaattcaatcatgtttaatatgtcagtcaaaaccaaattcagaattgttttgtgtaccagtcagctgttgtctgcacattttcgtagtgacagtgtggagatctttttaatgaaagcaaactatgtggcctctgcaaagaaaggaagatttttctttttacaactagatattagttttagaggaaggaaatagctgaaaaactaaatttgctttggtgaaatgtcctgtacagaacagtaccttggcattcagcagctgtaattggggaacattaaaacagtaactgacatccagttaaagccacgatcgtcagcaattctccttttttaatttctgatatttaaagttttttttccagtctacaccaggcctctccaaggagacagttcattatttaggagtgaatgtgttcctcttgcaatattatcagtacctgcatgacttggtaaattcattttataaaaatagtgttttttttttttaatttcagttcattgactctataactgcagaaattagataatgttttataaaataaatttgccacataatatgggatgcaataaccaacaaagctgctaagtgccaaactgttattttactatatataaatattaaaatattgtgttgaagtatagggatgtatttaattttactatgctccaacattaatcatgactcttttgtaaattacagttatttcagtattgtaaaataaatgttgactcatttcatgcaggtttgtgttttaacattccacttatgccttgaaacatcatttcttgataactttttgatacttctttcttgataaggcacttttaccaggtgtgtgttggaattggtggctcaggataggtcttaaattttaaatacaaatatctttgggggaagtgcaatttattttcagaaggaaagttgtctcaggttagaataagtaaatatttaaagaacctctcctaggctgcagtctaaaataggtagtttgtttctttgtttagcatatccaaatttagatttttcaaagatttaagtgtttattgaaagtgttttttgttttgtttttgatagtgcttatatcctgtgaatagaaaaagtgtgagagatgaatgagtgagttgtacgtgtgtgtgtgatgctatttgacctgataaatgtatttgtgtttactttttgaattgtagttctaaactacatatattactgtctcctggtgcttcagataaattcttgagcctgttgaccttcagtttatactactgtgtcgaactcatattgagtgtaaatattgaaatatttgtagtttatagtaagttttacttggtgttcgcgtttctcttcttcagcaggattaaaaacagtgtttaccaactcgtagttggtatactgtcaggatttggcctaagaaatttctgaatgcattgtttagcttagtacttcattgctgtaaggaattgatagctaactgtaggcttttttcaaactgtataacaaccaaaaaggagcatttgggggtatgttggatggtgttttgtttgtaaacactttgttatattgcactaccactttaatgatgacacttccttcattgatggcttggaagtgtcatttttataatttatgagttggggggattccctagtcaatgcataggaaatacattctttgtacaaacgtggtaaagagaggactggctttgctatggcacctaagttactcatgggtagttaagtttcatttctagagaaatgtcttagctgctgtggtccattagagttccctttggtacattcctacctcagtgtaccaaaccagggattccaaaaaccttccaaggagtgctagaaacaccgcagtatccccttccagaatgttggcgttcatgattcaagaggcctcccgtggtcagatgaagacctttggttaaatgggggaagaatgaggtggcgctttgactgtatcaatttaaagatgccggaaccccgttaaaaacacctggtggaagggaaaggtgaggcggcccttttccactggctgctcactgagcactggagtccaggaagtcagtgagaagagagcagctgagtgtagcaaaacccgccttgggtcagccaacacatgtctgatgagcacccactaggaactgtgcttgccatcctgggagctgaacagtgaggcagaggtcacaccactctcctactcaaggtcataaacccactatggaacgggcaagggccccgtctttgtcatctgccagtctcagtgcttgcacagagtaggtaggcaataaacatttgacaaataaatataagattcttgtgatcaaagtaatgttcttctgttgaaaagggcactccaagagtgactgattttactgggttttcagtgagaaactttgtacccatatgggctggcctcctatacggagctgaaactagcatgggccggcctcctatatggagctgaaactagtatagcataaacaatgccaagtgcctgatgtacatgatgtacagtcttctgattgtaccctctatatgggactatgagaccctctatagactcagcacagcttataatgttgatcatgtttagtattgggctttattgactgctttttatatgggtgtcaaaatctttccaggacatacccctttgatcctcacacctctggaataggcagggcactctccccattgtaccagggtaatcttggaggcctgatagatatggcttcatttctcactttagggaggagcaagaaccaaaagcagaagccaggtctttggattatcagctcaccagtcagccagtgaggctggaacttgatttttctaggcatacaagtatttttagtaatagaataatcatttttagtattaatacaatttacgctcccaaacatgtcctttgctagttgcacaggcataagctgaaagatctttgattttctttgttagttagctataggaaggttaagaatttatttactaaggtcgtaagaacagaagaaagtttctttgaaagagaaactgtttttttatttcaaagagcttcatgtatacttccctctcttattccatgtaattagtaagggaaaataaactatgtcttagaatgttgaggaaagtattttgatagcttttaataattcttgaaatactctttactctgtctgtagttttgagaaattacagaaattcatagtataaggatgagaaggggcccatttgcccatatttgataacacagacttggattgagtgtctgtcatgcctgctggcagttaagtctcagtggtattgactgctaggcattttctatattttttgcaagttagctggtaaaacttggtaaagttttgtgtttttcagaaggaaccctattattatttccattttaaacatatttcaatattgtctcattgtaatagttccatttatgtgacatctgaggaattaaatcatacttccagatggtttggtctaatgtatacagtttaggaaagtttattcttttttattttattttatttttttaaatttcttttagaaactgggttttgctctgttgcccaggctgatcttaaactcctggcctcagatgtggagacccagctgggactacaggcatgagccaccacgctccgtagaaagtttgttctttttcagttctgtcattgaaattctctaagtgattggatttttaaaccccttccccttttcatgaaattaaacatcaaataaataaaactacattatataattatttagtcagaaatgactgttgccctctcttttttttttttttttttttttttttttgagacggagtctcgctctgtcgcctaggctggagtgcagtggtgcgatctcggctcactgcaatctccgcctcctgggttcaagcaatcatcctgcctcagcctccccagtacctgggattacaggtgcttattaccacactcggcgaattttttgtgtttttagtagagacggggtttcaccatgttagccagcatggtctcgatctcctaaacttcgtgatccgcccgcctcagcctcccaaagtgctggattacaggtgtgagccacctcgcctgccctctttttttttttttattttgagattaaaactaattcttttaaagtcactactcagctgaaatttggcctgattataaatgttgataataatttcttcctggctcaacaaagttgttgagcttccttctgtgcacacattgaaagaaaaccagaaattgtacagtcgtgatatgaattagagaaggaacaggtggaaaaggatggcaacacacagagtccgggggacacacggccttaagatgaagtgaacgagtagacactgaataggatccacgtaaatgaacggccatttcaaatcattcacatcccaaacggaggttcatctgtcttctggttggtgaattatatttattaggatcttatttttagcatttcattacaagtaataggtttgggtaccttatttttattgtttttactcatcagttatgaataaggcataccttagaaacttgggttaaattttttcaagttataccagtcaacttggtttaaatacaactgtactaacttgctttatcatgtttcctgtttaattggatgagaattacatgcacttattcagttgttctttgtgtttataggaaaaactctgttctcagctacctcattatgtagtattgtgcttgatcccctgccaattgagaagaattcaacacattctgttctttaacaaaagcttggaagcaggcagtcagaggccttgaggaatacaattctctaaggcctgttttccattttactacttaaaaaaaaaaaaaaaagaaaagaaaaaaaagcacttacaaccaggaggaataataattctcctagagttgctgcaaactgattacttgaaactcaacttgaactttaaagagtctttaaaaggctgttttcataatgcagaaaagtagtctatttaaacgccactgctgtgtaaaacagggggctcgatttccattcttgttagcatcagacaagaaaatgtgtctatctgtcatctgacccagtatttgggatttgggtgcttgaggatactatttttttcatttcttataaggtgctattgtttcccagaaatctttaattttgatgaaaatctactcattgctaagatcctcctcacttaaagtgtttcctcagtgcagagttgaggttggcagaactatatagagttggatgatactgaaaatcatgaatgatgtgatttgttccatgtatctgtggaacatccctcaccttcctccggtatgcgccttctgcactccacacgtggtcgcctccatcctccctagtgtctgtcagcttgcctggtcaccaagtcaggaggaagaagatgaggaggctcaccagttgtaggcaagactcttcctctcgggagatcttgtaataatggcccagtttcagggcacagttgtacacattctacttaaatggaggagttcagtgatgccgtggccaaaagagttatgcccatttctaaaagcctggcatatttggtataacttaagcaccaggtaaaatctggtgcttaagttgtaccaagtatagccaagtttaactgtcgttgtgtattaataagatttaatttttatgcttgtgcttttcagagtaaagggcttgctttcaatagtagaatgacaaagcttctcctccaatgacaatctgttagcaccctgttgacttagctcaggacatgagactgacttagctcaggacatgagacatttcctggaagtgatttccatgagaacaaaggcttattcctttaacttaaaccccaaactttgttattttaattattttcaggcaatcatctttatatactttccttacaaacccagtggttgagagcataggccttggtggcaggtgcatctgggcttgggggcttctgccacacttactactctgtgacttgggaagctcttaaggctcccaaggctccgtttcttatgtggaagaagaatagcaggaggactcacctctgcgggttgttgtgaggattaactgggtgatgactgtaagcagctgggagagtgccttgtgtgcagtgaccactgttgctgccaccatgattatgtcacctctcaacatggggtggtgggaggccctgtggatgaggccaaggctgcctgcactgagtgtcccaggccttatagctttccacattctcacgtctgctgccacatgatatacaagtaaatgtattagaagttggtgttcataaaatacttttttttttttttttttttgagatggagtctcgctccgtcacccaggctggagtgcagtggcgccatctcccaggctcaagggatcctcctgcctcggcctgccaagtagctgggactacaagtgcacaccagtatgcccagctaattttttgtatttttagaacaggtgtggtttcaccatattgcccaggctggtctcgagctcctgagctcaggcaatccgcctgcctcaacctcccaaagtgctgggattacaggtgtgagcatccagccagaaaatgatttgctttctagacccatatcacctctctccatctacatctctagtatttaaattcaacacaattctagatagctgaaacagcccaaaatatgtgtttagaatacttagagtttgttataaataaccctctgtttagaatttgcccagtgaaattctctaataatacttaaaactctttactaaagttgaattttccttttttttcattgaaatagcaaaggtagtaatctgtattggtcaaagaaacgagataattcctagatctctgttttagaccagtagacctaactgtgctttcttaacttggatgttacatgaaacttaaaaacaaacaaatatgtgttacaagtacttgtgtgtacgtgcatgtgtgtttgtgcatgtgtctgtgtgtgtggaacttttgtacctttgcataaagaaggttatttaacaaagtggtacaaacagtgaactacttaatccttctatggtatcatacacttcttttcctggttaggttatgagactggcagaggtaggagtatataatgtgctcagcttgtcttgatttcaataagacatttgataaagtcattcttgatctctgaatgtgaaaaggaagtagaacagccgggcgcggtggctcacgcctgtaatcccaggactttgggaggccaaggcgggcagatcacctgaggtcggcagtttgagaccagcctgaccaacgtggagaaaccccgtctctattaaaaatacaaaattagccgggcatggtggcacatgtctgtaatcccagctactcgggaggctgaggcaggagaatctcttgaacccaggaggcggaggttgcggtgagccgagatggtgccgttgcactccagccgggcaacaagggctaaactccatctcaaaagaaaagaaagaaagggaagtagaagtaggatttaacaaaggaccgagaagtcggctgaatagccaggttcagacagtgttggcaagaacggatctttggcaagatcacttaaggtgagctactctagcagcatcctgtttgacatttgtatccataacttgaataaaaatatagaaggcaaagaagagtgctgggcaagatgtgttgggtgttagatctgcaatactcttcatagtgtaatggctaaatgtaaagtcttacgtctcggttcaagaaagcacgttgctatatgaaatttcagaaaaaagttttgttgcggggggtgggatattgatcatttgaacatatgccagttgtttctcctgccctaggggaggttggcacggcaaccttcccactccgtaggtgggtagccttgctgatggggcacgtcgtcaccaagggacctgattgttgtcatggttttgtcttgtcctcctccctggtgaaagtctactgcagttttattctcagctctggaaggagagggaacgagcctctgcctgtgtgtcctgacccctcttgccttgtttttgatctgctcaggccgggtgcagtggctcacgcctgtaatcccagcactttgggaggcaaaggcaggtggatcacttgaggtcaggagttcaagactagcctggccaacatggtgaaaccccgtctctactaaaaatacaaaaattagccgagtgtgttggtgggcccctgtaatcccagctactcgggaggttgagggaggagaatcacttgaccccaggaggcagaggttgaagtgagccaggattgtgccactgtactccagcctgggcgacagagggggactctgtctcacaaaaaaataaaaaattaaaaaaaaaggtctgctcagaaataggggaaacacgggatcaagatcattagagatttataggctgggatgcacaccatgtcttcagagctagccggctgtgtcttctccccgtttctttcactggtgaataacctttcgtttgaaccagccttgattgttctctccatgttccactgtggctccccatggacactgctaggtggaatctctgagaaaacaggcacttcgcagtcggcgcatctttctctgccagcttagggattgccgtcaaggtggaggaagggtattttggccatgttcggagtcgttgtttttactcactcttcttgggatagctttcccaccctgccctctgctcctctgtcccaaccctcttccagcctggtttttttactgcttgaattatgtatccaaaataaaaaggaaaagaaaggtgcagttggggcgggttgttgggggcgaggagaatagcccttctggttcttcagaccacataatggccagagcatgagcctcacagatccctgagcagacctgcatactagcactttccacaaccagctggccctggctgtgagagtcagatctgtccccaaggctccaggtcagaacttggacccaggtgccttctgaggcaccgccaaggacacatcccagcgccttaggcacctgtaggctagaatgacaccttccaggccagccccagaggccctcagggctccccctccaagccgggagggcaggcaggcacaggccccgctcactacctcagcacccagtgcagccccaggctcccggacgtgctcggcccggtggcctcttgtgtgacaggccctctgccatgtctgtccgcagagccgggtggggaccctccgtgtgggtcctcctctgtccctttgcagctcgcattcgccagagcggagcgcagcccttgtttccttctttcctcttcagctctgacttaaaaacacactatgttccaaatcgttgtgggatcggaaactagaactgcttgtttccaggagagaccaccttttcatattttttttaaaaggaatttgtgcttcaaaagaaactccaaaaaataaatttattgttagtctagcatatgctcattgaaattgacttatgttttattttaaaaaatcatgtaggatctggtacatggggcgggcaaaagggtatcatcagcttaagaagtaaagaagtgagccttccatttgtgtgggtgataacatctttttcctagatcgtacctcaaaattcaggctctccatgaaaacaaagataatctgaataaaaattgtgtgttgggaaatgtatcaagtgaccttcagttaagaaaagcacaggctgtttattagcacaacttgcttcattaaataattcgtggctttttctgccactggggttcttttcgttttgaattcagcttgtgtttggttcctcggtcttgtaccccttcagttcgccggcgacgtaatggtgataccctttgttttttgtatcataccttttgtgaattgtgacaaccatcccgtaatcattgtggcctcagcagaagttttgaacaatctttgcagccactgttggggtgtgtaccagcagcctggaagtgaccagcagagctgacaaaagcaccccctgctctgcccacctccgcagagtcctgtcctcatcagaaacggtatcgcggatgctcctcaggtaggcgtaggcagacttcattgtgtgttagcagtgacagtgatgtctgtacctatctgtgagtgagacccattcatgacacactagaaatgtgtacattcttttgttttccatcacgggtataggtcttctgccatgaaagagaactatcaaggaaattcctgaaaacaagatttgtaaattcgatttgaccctcccaaattcagggctgctctttgcagtggtccctggcccagcaggtggccggcgtggctcctgttggctcatgccagtgttgtgctggaccctcgagtatgtgactgtcacccttgtccaagactggtttttaacagtcttgatttgtcattttgatgctttgaatactataaggaaaatgccacgaataccatataaataccacaccaatctgttgaacatatctgtgttttctgacatgggacctgcagaatagtatttcttttaaatcctgcaactttattatctagtagaattccaagtaggtctgcttagacacatattcagtgaagattgtattgtgtgtgatattatcctatctttaataaagtcctactactgaaaaacagggatttgcaatgaaaatcatagctaaataggcaggtttagaaagttcaaaatattggaagtgctagaaggctgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataagaaatttagcagtcagaagtaatttttaattaataacctttctttttaaaagttgctttatggtttacaagtaatactgatgcaaaaaggatttgttaacctaaattaagtagcacgcactttgtttacatgcttcagtatattgtggggttggtcccttctcacgaacccaggacctgtgcttggggaacattttgccatcatgctgttctcttgtaccaaggatcagtgaaagtgttttatcttttttatgtagtttgtattgactggattttataactgtaagaaaacagaaacagagtgttgtattttgatctgaaatttgtgtatgctaaagtaattttgttttatgtattggaagttcacttaaaaacttgaaatattttctagaagggtaccacacaaaaggaatcatctttaagctgtttaattaacctaataaaataatttgatggggaaggcattctaattgtttctgatttttagagtggttcctgctaaatcatcattatcaatacagcttgatttgatttaagaa

SEQ ID NO: 137035 - DNA, 2148 bp, Homo sapiens
  Payload ID: 6827
  Gene Symbol: GIMAP1-GIMAP5
  Gene Name: GIMAP1-GIMAP5 readthrough
  ENST ID: ENST00000611999
  CDS Start-End: 30-1565
ttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccaca

SEQ ID NO: 137036 - DNA, 3249 bp, Homo sapiens
  Payload ID: 6828
  Gene Symbol: GINS1
  Gene Name: GINS complex subunit 1 (Psf1 homolog)
  Uniprot ID: Q14691
  ENST ID: ENST00000262460
  CDS Start-End: 95-685
ctagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagtcttgttctgtcacccaggctggggtgcagtggcgtgatcttggctcactgcaatctctatcccctgggttcaagtgattctcttgtctcagcctcccaagtagctgggattacaggcacaggccgccacgcctggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtagagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaatttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttc

SEQ ID NO: 137037 - DNA, 2673 bp, Homo sapiens
  Payload ID: 6829
  Gene Symbol: GINS2
  Gene Name: GINS complex subunit 2 (Psf2 homolog)
  Uniprot ID: Q9Y248
  ENST ID: ENST00000253462
  CDS Start-End: 102-659
gggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataa

SEQ ID NO: 137038 - DNA, 537 bp, Homo sapiens
  Payload ID: 6829
  Gene Symbol: GINS2
  Gene Name: GINS complex subunit 2 (Psf2 homolog)
  ENST ID: ENST00000596233
  CDS Start-End: 384-537
ctcgcgggcctaattatcaaggtttcaaattcgactgcagtcctagaatagcgcttcacccccaggaagcttttccggccatgaccaccccatcaaaatcacctggccctggatgaaattcagctttctgtcctttccacgactccggaatcccaactcccaggagcgtgcacacagacaatgggcacccgctaggggattctgacacaggtgagctccagccaccgctctggcttcacctgcgcccactgtacaggggcagccggtccagcgagcagggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctgg

SEQ ID NO: 137039 - DNA, 625 bp, Homo sapiens
  Payload ID: 6829
  Gene Symbol: GINS2
  Gene Name: GINS complex subunit 2 (Psf2 homolog)
  ENST ID: ENST00000595355
  CDS Start-End: 419-625
cgagtagctggattgtgagcccccgcgcccgcccggctttgcgttttcagtatgagggaggcgcctcggcgctgggagtcctggagaaggagggcaggctctgtacctgcccagacccacctccccgcaccccaggaccccaacattgggtgtgtgaaacctgttccggagttggagggtgcaggcgggagagggagcgccccccacccactcaggggagacttgcatcctgtccgcggaaaggccagaaggactgagccccacgctcgcaggtgtctcggagccgctcaggaggcgctttgttctgagtctgggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagc

SEQ ID NO: 137040 - DNA, 2274 bp, Homo sapiens
  Payload ID: 6830
  Gene Symbol: GINS3
  Gene Name: GINS complex subunit 3 (Psf3 homolog)
  Uniprot ID: Q9BRX5
  ENST ID: ENST00000318129
  CDS Start-End: 209-859
agacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaatccatgttttagca

SEQ ID NO: 137041 - DNA, 1932 bp, Homo sapiens
  Payload ID: 6830
  Gene Symbol: GINS3
  Gene Name: GINS complex subunit 3 (Psf3 homolog)
  Uniprot ID: Q9BRX5
  ENST ID: ENST00000328514
  CDS Start-End: 209-625
agacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatg

SEQ ID NO: 137042 - DNA, 1728 bp, Homo sapiens
  Payload ID: 6830
  Gene Symbol: GINS3
  Gene Name: GINS complex subunit 3 (Psf3 homolog)
  Uniprot ID: Q9BRX5
  ENST ID: ENST00000426538
  CDS Start-End: 209-976
agacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttttgctctgttgcccaggctggagtgcagtggtgtgatatggctcactgcagccttgacctcccaggctccagagatcctcccacctcagccacctatgtggctggtattgcagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtc

SEQ ID NO: 137043 - DNA, 3841 bp, Homo sapiens
  Payload ID: 6831
  Gene Symbol: GINS4
  Gene Name: GINS complex subunit 4 (Sld5 homolog)
  Uniprot ID: Q9BRT9
  ENST ID: ENST00000276533
  CDS Start-End: 211-882
gtgcctgggcggaaactttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtgacgttaaccatcttgtattgtgacctgtggccgcttttctggtttaagtccttcactttttcaagaggaatggatgaaattaatgtgcatgcagagtctcacagtgatgccggaaggaaggatgtataggcagtgaatgaatgatctttccttgaaatgctataaaaagcaacctgcattccagtcttttcttcctggttgaagttggcagatttccatttgcagggtatgggctgcgagagtaatcagggtaacattgctgtcatttccaagagaaatcagtaggggaaagcaagggaggtcttttttttttttcttttttgagacggagtttccctcttgttacccaggctggagtggcagtggtgtgaacacggctcactgcagcctccacctcctgggttcaagagattctcctgccccagcctcccgagtagctggtattataggtgcacaccaccacacccaactaattttttgtatttttagtagagatggggtttcatgatgttggccaagctggtctcgagctcctgaccccaggtgatccacccacctcggcctcccaaagtgctggaattataggcgtgagccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaaagatgtaggttctgaaacagggtgaggtccaggatcctgcctttctaaggagctcccatgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaa

SEQ ID NO: 137044 - DNA, 1158 bp, Homo sapiens
  Payload ID: 6831
  Gene Symbol: GINS4
  Gene Name: GINS complex subunit 4 (Sld5 homolog)
  Uniprot ID: Q9BRT9
  ENST ID: ENST00000518671
  CDS Start-End: 172-843
cgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaa

SEQ ID NO: 137045 - DNA, 3873 bp, Homo sapiens
  Payload ID: 6831
  Gene Symbol: GINS4
  Gene Name: GINS complex subunit 4 (Sld5 homolog)
  ENST ID: ENST00000523277
  CDS Start-End: 168-746
agttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagaggtgagtggcgtgcatctttcacagtgggcacattcctcccgatggagggccagccgagctctgcaggcaaatgtgtttccctctttttcagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtgacgttaaccatcttgtattgtgacctgtggccgcttttctggtttaagtccttcactttttcaagaggaatggatgaaattaatgtgcatgcagagtctcacagtgatgccggaaggaaggatgtataggcagtgaatgaatgatctttccttgaaatgctataaaaagcaacctgcattccagtcttttcttcctggttgaagttggcagatttccatttgcagggtatgggctgcgagagtaatcagggtaacattgctgtcatttccaagagaaatcagtaggggaaagcaagggaggtcttttttttttttcttttttgagacggagtttccctcttgttacccaggctggagtggcagtggtgtgaacacggctcactgcagcctccacctcctgggttcaagagattctcctgccccagcctcccgagtagctggtattataggtgcacaccaccacacccaactaattttttgtatttttagtagagatggggtttcatgatgttggccaagctggtctcgagctcctgaccccaggtgatccacccacctcggcctcccaaagtgctggaattataggcgtgagccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaaagatgtaggttctgaaacagggtgaggtccaggatcctgcctttctaaggagctcccatgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaa

SEQ ID NO: 137046 - DNA, 2022 bp, Homo sapiens
  Payload ID: 6831
  Gene Symbol: GINS4
  Gene Name: GINS complex subunit 4 (Sld5 homolog)
  Uniprot ID: Q9BRT9
  ENST ID: ENST00000520710
  CDS Start-End: 983-1285
ctttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagtgagcgtcgaatgggacctctgtggctagggcaggcctgtgtgggtggcactgagagggaggaggggagggggatgttcgcagtttccttgcgaccccagggactttctttgtccccgccatccacctccttaggcctttgggatcgccgactggtctaatgtcgccggcccttgtggctctgggaaattagcattgattaatcttcctaacaatttttgtttttatagagacaggatctccctatgttgcccaggctggtctcgaactcctgggctcaaggtatcttcctgcctcggcttcccaaagtgctgggattacaggcgtgagcccggccagctcctaataatgttaagtgcttgctaggagtcaagcgctgtgctgagcgcaggggcttcccacgtcattgcgtccccagtgcttagtgccaggcactgagcagaggcgcgattcgtatttgaactaaaacgaaccccgtccctgaggaacaagacctctactgggaagtcaaagaaatgaatagtgattgtatggtgtgatgggtgctcagctcttggtggacagaagtaagggggaggcttgtttgagaaacggatacctgacctaagccttggaggaagaggcagacactggaaaactagagtccctgcgttctctcaccacttgctaaagggcctctacaaccccaggaaacctcaataaacctttcctttctccagatagatgtctgttcttgcagataattagaaaacgcattgcagagtattggttctttccctctcattaggttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaaggtttgacgtggagatacctggagggattgagacagcacagtctgtaatgcagactgaatgtcctggggaaaacttgggctggggcccaggagggtccaggacctgaagatgctgctaagagcccaatatccatgtagctaaactgtaaggagagcgagagattgctccacagaagcacagaggaacgtgtgtggcccactgcggggacaccgcacacatttttagtctgttcacctgccgagtgagtggttcccccttgcgttacagcatggcagtgctaaagggagagttgttggcattggtcaatagtgaatgctgactagaggagaacttgtttccaaaattattttgtctgtcagatggccaacgtcagtgtcaaatgaaccaggatgacttacattcacctacagctttgtggctatctaacttacaaaaatgaagttgcaggccaggcgtggtggctcacacctgtaatcccagcactttgggaggctaggcgggtggatcacctgaggtcaggagtttgagaccagcctgaccaacaaggtgaaaccccatttctactaaaaataaaaaaattagccaggcgtggcggcaggcgcctgtagtcccagctactcaggaggctgagacaggagaattgcttgaacccaggaggtggaggtttcagtgagccaagattgtaccactgcactccagcctgggcaacagagcgagactccgcctcaaaaaaaaaaaaaaaa

SEQ ID NO: 137047 - DNA, 835 bp, Homo sapiens
  Payload ID: 6831
  Gene Symbol: GINS4
  Gene Name: GINS complex subunit 4 (Sld5 homolog)
  ENST ID: ENST00000520354
  CDS Start-End: 199-513
aaactttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagttcccaaaccagatctagattcttacgtgtttctgagagtgagagaacgacaagaaaacatactggtagaaccagacacagatgagcagagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagcc

SEQ ID NO: 137048 - DNA, 1782 bp, Homo sapiens
  Payload ID: 6832
  Gene Symbol: GIPC1
  Gene Name: GIPC PDZ domain containing family, member 1
  Uniprot ID: O14908
  ENST ID: ENST00000345425
  CDS Start-End: 127-1128
ggcccggtctggagtttgcggagggccgagccgggtgcgcacggggaggcggaggcagcggcggcggcggcggcggcggcggcggcggcggagcagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 137049 - DNA, 1483 bp, Homo sapiens
  Payload ID: 6832
  Gene Symbol: GIPC1
  Gene Name: GIPC PDZ domain containing family, member 1
  Uniprot ID: O14908
  ENST ID: ENST00000393028
  CDS Start-End: 117-827
ggcgccgctgcgggagaggcccggtctggagtttgcggagggccgagccgggtgcgcacggggaggcggaggcagcggcggcggcggcggcggcggcggcggcggcggagcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttgg

SEQ ID NO: 137050 - DNA, 1926 bp, Homo sapiens
  Payload ID: 6832
  Gene Symbol: GIPC1
  Gene Name: GIPC PDZ domain containing family, member 1
  Uniprot ID: O14908
  ENST ID: ENST00000393033
  CDS Start-End: 271-1272
ggcccggtctggagtttgcggagggccgagccgggtgcgcacggggaggcggaggcagcggcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 137051 - DNA, 484 bp, Homo sapiens
  Payload ID: 6832
  Gene Symbol: GIPC1
  Gene Name: GIPC PDZ domain containing family, member 1
  ENST ID: ENST00000587969
  CDS Start-End: 122-484
tgagttactgggatggaatccccctagtcctctcccagctctctcccttcgccctccagtggtgattagaaaagggggagggagggggaagaggtttcagcgtctcccacccctgcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttc

SEQ ID NO: 137052 - DNA, 853 bp, Homo sapiens
  Payload ID: 6832
  Gene Symbol: GIPC1
  Gene Name: GIPC PDZ domain containing family, member 1
  ENST ID: ENST00000589497
  CDS Start-End: 164-352
ggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaa

SEQ ID NO: 137053 - DNA, 265 bp, Homo sapiens
  Payload ID: 6832
  Gene Symbol: GIPC1
  Gene Name: GIPC PDZ domain containing family, member 1
  ENST ID: ENST00000591245
  CDS Start-End: 146-265
cttagtctgtcacccaggctagagtgcagtggtgcgatcttgggtcaccgcaacctccacctctccagttcaagctattcttgtgcctcagcctcccaagtagctgggattacagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcg

SEQ ID NO: 137054 - DNA, 799 bp, Homo sapiens
  Payload ID: 6832
  Gene Symbol: GIPC1
  Gene Name: GIPC PDZ domain containing family, member 1
  ENST ID: ENST00000589631
  CDS Start-End: 1-387
aagaggagacggactcaggcagctggagactcaggctgggacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggt

SEQ ID NO: 137055 - DNA, 330 bp, Homo sapiens
  Payload ID: 6832
  Gene Symbol: GIPC1
  Gene Name: GIPC PDZ domain containing family, member 1
  ENST ID: ENST00000587934
  CDS Start-End: 210-330
gaccattctggctgctgtctggacaagaagtcgtagggggtgagggtggaagctgggaaacccacaggaggcaaccacactagtttagggatgggatttcgacatgttggtcaggcatctcgaactcctgacctcaagtgatcctcccgtctcagcctcccacagtgctgggattacagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcgg

SEQ ID NO: 137056 - DNA, 1386 bp, Homo sapiens
  Payload ID: 6832
  Gene Symbol: GIPC1
  Gene Name: GIPC PDZ domain containing family, member 1
  Uniprot ID: O14908
  ENST ID: ENST00000586027
  CDS Start-End: 215-1216
ggcccggtctggagtttgcggagggccgagccgggtgcgcacggggaggcggaggcagcggcggcggcggcggcggcggcggcggcggcggagcaggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccat

SEQ ID NO: 137057 - DNA, 1068 bp, Homo sapiens
  Payload ID: 6832
  Gene Symbol: GIPC1
  Gene Name: GIPC PDZ domain containing family, member 1
  Uniprot ID: O14908
  ENST ID: ENST00000591349
  CDS Start-End: 188-898
ggcccggtctggagtttgcggagggccgagccgggtgcgcacggggaggcggaggcagcggcggcggcggcggcggcggcggcggcggcggagcaggaccattctggctgctgtctggacaagaagtcgtagggggtgagggtggaagctgggaaacccacaggaggcaaccacactagtttaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccat

SEQ ID NO: 137058 - DNA, 576 bp, Homo sapiens
  Payload ID: 6832
  Gene Symbol: GIPC1
  Gene Name: GIPC PDZ domain containing family, member 1
  ENST ID: ENST00000587210
  CDS Start-End: 100-576
ggcccggtctggagtttgcggagggccgagccgggtgcgcacggggaggcggaggcagcggcggcggcggcggcggcggcggcggcggcggagcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctg

SEQ ID NO: 137059 - DNA, 3847 bp, Homo sapiens
  Payload ID: 6833
  Gene Symbol: GIPC2
  Gene Name: GIPC PDZ domain containing family, member 2
  Uniprot ID: Q8TF65
  ENST ID: ENST00000370759
  CDS Start-End: 194-1141
gctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggagatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggaactctttactatgaagttaatagaacctaagaaggcatttgaaatagagctgaggtcaaaggctggaaagtcatcaggagaaaaaattggttgtggaagggcaacacttcgcctgagatcaaaaggtcctgccaccgtggaagaaatgccttctgaaaccaaagcaaaggcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttcttttttttctcttttttaaaaagtcctataagatctgtttttggacacctttactaactctggtttaatttcatgtgtatggaatatattctttgaaatataattttggtaattttgatttctgggcactttttaacattgctgatgtagtatgcttaagagaaatgacctaaataaggatcaattgtaatattcattcaaaaggtttttaaaagtaagttttaaggagtatttctcgacagatgattttcttctccattaatacccatgctttgtttttcacatataaatagatgatttcaatagctttgtagttttttttcaaaatcttaatgtaaactaggattggagtatgatttacctcatagtatcttcactgtgttatcctagtttgaacaggatatgttcaggaaatgaaaggtgaattatgccccttattggtctagaagcattggtttttttttgatcctctgagtaagggaaggaagattcctgtggcatgttgatttctatggccaactttctctctttgtaaaacaaagattgattgattttcttgtatgcttctttatacatgctcttaaaacttgtggttgaaatctgtgctgtgtgtgtgtgtctctgcatgtgtaaaagaagggtaaaaaagagatgggtagggtagaactacttgcatttgatttttttttcagtccttaaaacattatttctttttttcactcatagccacttttatgttaccttttataagcactccagggaagattttatatttttttgtagagtttttggaaagatatttactcaaaataactatgctttagaactttttttttttttttttttttggttaaacagcagcactttttagttccctaaactttagaagaaatgctatcagaaatagatttccttccagtggaaagaaaggaggaagggagaattgagaaaatatattagtctattattttagagttctaatacactctaaattaaagagaaaattgagagtaaatgactgtcttatcactcttatttgacatttcgtaggtgtaagagaaatggaaatgaatggtttcaacaaagatcatttaatacagcagagcatggcatgaccaagcatctttgtaaagtgttagatggaaaatgctgtgtgctgccatggtaatcagaaataataacctgttagggatgtattctaggaaatcagaagtagttctcttttcttgctggattattgcttagataactcttgttttctggtaaaactttagttgtattgccatccactcctttttcaaatgagtttaatgccataaagctgatattctttgtccgattaatttgaaatctgcacagaagctgttttagtcattaatgtgtaacaaaagtagcttatagaatatggactgccttattgctgttgcttatcatttgaaaataaaatccagctcaggttgtaacttgttggtactcgtttagtgagttcgttttggaggttctgaaatacctattaattcttaatattacctctcttggaaagacacaaaaaaagagctgttatttttaggcataagatgacttaggaggcccatagaaacattctcgtttaaacaacaacaacaaaataaatttatcagcactagatattagatttgaaataagtcattgttcattattgatggttgtcagtttctccttcctttttgggcatgcataaagacacacttggtgctgattccatgtgatttatggaatgtcattttcacaatgatctttctagaatttgtgtgtaaggttgtgatatccatgtacagctgtaactatatatacttgtctgttagcattcagtggaccattatcattactatcatcacattacctgggcttcaactgggcccaagtactctatatactgcctgtaataggtttttccttgaaatatccttatctttcacctctacagctaaactgataacaaggtcagtttctttatgtcattttattcccatacctaaaattgcatctatttgtgagctttctgcctttttgtaacgctcagtgcaccaaaagcgtctgtttttagtgcagtcacataatatataagtgtgggatacccttctgcagcttcagtgagacaaatcactttttaaaaaacattccattttattggcatcactagatgtttttaggaccctgtccttttcacttttctgtaggctttttttttttaaatggaagatgattattttgtttgttcttgatttcctgttattgaaaacagcatcttccttcttgcaatggccactaatagcacacaatgcgttttctttgattgtagcagaaaatgcaaatgataattgtatgttgggctcgatgaggccttgaacatagctgagtcctaatcagatgtatatactctgatgattacaaataggtacatgttgggtttctgtgatgtttcaaaaatacaattatataattatgatgtaaactctttaagaattcaattataaaagcaataatcaggtaacctctatttggagctgctacatccaatattgtgactgaaaattaactaaagagagataatttttcaaatgatgtataatttgcaatattttcccttgcaactttagcaaatacacatattccaagtaaaacttta

SEQ ID NO: 137060 - DNA, 4335 bp, Homo sapiens
  Payload ID: 6834
  Gene Symbol: GIPC3
  Gene Name: GIPC PDZ domain containing family, member 3
  Uniprot ID: Q8TF64
  ENST ID: ENST00000322315
  CDS Start-End: 46-984
gcggcggcggcgagggcccgggtgggtggccgaacttctcccgccatggagggagcagcggcccgggaggcccgggggaccgagaccccgcgcgcgtctgcgcccccgcccgcgccctcggagcccccggccgcgccccgcgcccgcccgcgcctcgtcttccgcacgcagctggcgcacgggagccccacgggcaagatcgagggcttcaccaacgtccgcgagctgtacgccaagatcgccgaagccttcgggatcgcgcccaccgagattttattctgcaccctcaacagccacaaagtggacatgcagaagctcctggggggtcagataggcctggaggacttcatctttgcccacgtgcgaggcgagaccaaggaggtggaggtcactaagacagaggatgctctggggctgaccatcacggacaacggggctggctacgccttcatcaagagaatcaaggaaggcagtatcatcaaccggatcgaggcagtgtgcgtgggtgacagcatcgaagccatcaacgaccactccattgtgggctgccgccactacgaggtggccaagatgctccgggagctgcccaagtcccagcccttcaccctgcgcctggtgcagcccaagagggccttcgatatgattggccagagaagtcggtccagcaaatgtccagtagaggcgaaagtgaccagcgggagggagaccctgcggcttcgttctgggggggctgccacagtggaggaagcgcccagtgagtttgaggaggaggcatctcggaaggttgatgacctgctggaaagctacatgggcattcgggaccccgagctggcgtccaccatggtggagacgtccaagaagacagcgagcgcccaggagtttgcacgctgtttagactccgtcttgggcgagttcgccttccccgacgagtttgtggtggaagtgtgggccgccatcggcgaggccagagaggcctgtggctagtttgccctgggggggcccagcacagccccagcccggagcccagccccctgccccggccctgctccagaacccagcccagatcggaggacaagttcctctctagaacccaatccaatttggagccccagcccaactccagaacccaacccttctctagaatccagcccagatctgaggccaagctatgtgctagagcccaggccagctctgagaccaagcccagcattgagaataagctctgttctaaaactcaggccagccctgagaccaagcccagctctagaactcagatgagctttgagaccatgcccagcactgagaccaagccctgttctagaactcaggcctgctctgaggccaagcccagctctagaacccagatgagctctgagaccatgcccagctctagaactcagatgggctctgagaccatgcccagctctagaactcagatgggctctgagaccgagcccagctctagaactcagatgggctctgagaccgagcccagctctaaaactcagatgggctctgagaccatgcccagctctagaactcagatgggctctgagaccgagcccagctctagaactcagatgggctctgagaccgagcccagctctagaactcagatgggctctgagaccatgcccagctctagaactcagatgggctccgagaccaagcccagctctagaacccagatgagctctgagaccatgcccagctctagaactcagatgagctctgagacagagcccagtattgagaccaagccctgttctagagtccaggccagctccgagaccaagcccagctctagaacccagataagctctgaaaccaagcccagcatagagaccaagccgtgttctagaattcaggccacatctgaagccaagcccagctctagaactcaggtcagccctgagaccaagcccagctctagaacccagataagctctgaaaccaatcccagcattgagaccaagccctgttctagaactcaggccacctctgaggccaaacccagctctagaacccagataagatctgagaccaagccctgctctgaagcccaggccagctctgagacgaagcacatctctagaatccagctgagccctgacaacaagccaaactctggaacccagacacattttaagacccagaccagcttggagaccaatcccagttccagaatccaggctagctcggagaccaagccctgctggaaaactcaagctgactctggaactctggacagctccacgatgcagccacacctggacactcggtctagctccggaaccccagttaattttggaacccatgtgagattcatgaagcagcccagctctggaaccccagtcagctcaggattcagagacagctcccaaatcaaatcctattcaagaactcagaccagctcagaaacccaggtccacacggctgcccagtccagatcccaaccccagttgcatccaagtgcccatccccatcctgcagcccagtccagctccagtgatgattccagctctgagactgagcccagctctagaacctcgcctagtgctacaaccaggcccaactccaggattcagaccagctctggaaccccatccatcttggaagcaagacccagctccagcacacagcttggtgccaagccccactctccttgcacaatgcagctcagctctagaatgcagtttacttccaggacccagaccaatttcaaggcctggccaagctccagagctcaatccagcccaagcaccgcacccagctctggaactcagctcagttctggagcacaggctggttctgaaatcccagccagctccaaaacacagacagcagctgagacccagccaagttccagaatccagctaagctctggagtccaatctagtcctgggacccaggccatcgcagcaatagaattaagctccacagccctgtctagttccgacagcaggtccagctccaggacccagcgctgcccaggagctcgaccagcctctgggactcaattcgcctctaaaaccctgccaggttctagataccagctccagaccacagccccagacagctctggtattcaactggactttgggaagcagagcagttctgaaagtcagcttagctttggaactcagcccagctctgggacccagataagctcaagaattcaagccagctctggaagtcagcttagttcgggaacccagctgatttccggagcccaacccagctccagaactcagactagttctggaaaccagctcagctccgggacccagaccactgcaagaattcagctcagccctggagctcatcttagctccagaacccagtccagtcctgagaccaggctcagctctgaggctcagtccagctctggaacccagttcagttctgggattcagtttggctctgaaacccagaccggctcaagaattcagcccgactctggagcccaacttagttccagaacccagtccagctctgagaccgggctcagctctgaaacccagaccggctcaagaattcagcccagccctggagcccaccttagttctggaacccagcctgtttctggaacccaatccagttccagaactcacaccagttcaagaatctggctgagccctggaaatggaatctgcccacagacccctggccttgaccctagaatccagcttgaggcccctgccccagcccaacctcagcccccaggcccatcccccagagaccccaccccagcccctagcaaagacccccagcctctgcctcagccccatgatcaggtatgtggcatccaggccagccttggccccatcccaggcttaccccaagcctcctacctggccccacagtcacaggtctcctcaaccccccagaagccagccgtctctcccaagccccgggtgggaccccagaagtccaccccacccaccatatctgtcactcctagtcctgcccctagggcagccctcctgagttcccagctgtctgagtccccagctttggcgccagccctttgccccactctgggggagccaggagcccgcccttaccgcggggggccgtagcttggctgtgacttagccctggttcatgtggttctcgtcctctcctgtcccttccagcctggggcccccagaagcagcaagtgaccttatttctccagcaggcggtggtagggagtgtgcggtggtgaaaacaggggcttcaccggtcctggctcagatccaggtccttggagggaaaaggagggcaggagacgggttgcaccgcatgtaccctgagggctcatggtgaataaaggcaccttccatctctgca

SEQ ID NO: 137061 - DNA, 3321 bp, Homo sapiens
  Payload ID: 6835
  Gene Symbol: GLE1
  Gene Name: GLE1 RNA export mediator
  Uniprot ID: Q53GS7
  ENST ID: ENST00000309971
  CDS Start-End: 107-2203
gcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaa

SEQ ID NO: 137062 - DNA, 2218 bp, Homo sapiens
  Payload ID: 6835
  Gene Symbol: GLE1
  Gene Name: GLE1 RNA export mediator
  Uniprot ID: Q53GS7
  ENST ID: ENST00000372770
  CDS Start-End: 76-2055
ggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccaggtatcaggcttgttgagcagacagcaggggattaagtaactcataaccaggcctcagatacccaagggtgctattacctgctggttttgattcaagttaaaaacacctgtactaagtatgacatctttcctactccagtccctctcgttgatatttgaataaatgcttttgaaccttaa

SEQ ID NO: 137063 - DNA, 3613 bp, Homo sapiens
  Payload ID: 6836
  Gene Symbol: GLI1
  Gene Name: GLI family zinc finger 1
  Uniprot ID: P08151
  ENST ID: ENST00000228682
  CDS Start-End: 92-3412
gcacaccccccagcccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcag

SEQ ID NO: 137064 - DNA, 3196 bp, Homo sapiens
  Payload ID: 6836
  Gene Symbol: GLI1
  Gene Name: GLI family zinc finger 1
  Uniprot ID: P08151
  ENST ID: ENST00000528467
  CDS Start-End: 1-3196
atgttcaactcgatgaccccaccaccaatcagtagctatggcgagccctgctgtctccggcccctccccagtcagggggcccccagtgtggggacagaagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcct

SEQ ID NO: 137065 - DNA, 480 bp, Homo sapiens
  Payload ID: 6836
  Gene Symbol: GLI1
  Gene Name: GLI family zinc finger 1
  ENST ID: ENST00000528432
  CDS Start-End: 93-480
ggttaagtttaagaggctggagggatggctagctggaggtctgcgttgtagagaggtaaccccagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatga

SEQ ID NO: 137066 - DNA, 784 bp, Homo sapiens
  Payload ID: 6836
  Gene Symbol: GLI1
  Gene Name: GLI family zinc finger 1
  ENST ID: ENST00000532291
  CDS Start-End: 259-784
accgcacaccccccagcccagactccagccctggaccgcgcatcccgagcccagcgcccagacagaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgca

SEQ ID NO: 137067 - DNA, 3394 bp, Homo sapiens
  Payload ID: 6836
  Gene Symbol: GLI1
  Gene Name: GLI family zinc finger 1
  Uniprot ID: P08151
  ENST ID: ENST00000543426
  CDS Start-End: 259-3195
accgcacaccccccagcccagactccagccctggaccgcgcatcccgagcccagcgcccagacagaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatc

SEQ ID NO: 137068 - DNA, 3475 bp, Homo sapiens
  Payload ID: 6836
  Gene Symbol: GLI1
  Gene Name: GLI family zinc finger 1
  Uniprot ID: P08151
  ENST ID: ENST00000546141
  CDS Start-End: 79-3276
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatc

SEQ ID NO: 137069 - DNA, 1964 bp, Homo sapiens
  Payload ID: 6837
  Gene Symbol: GLI2
  Gene Name: GLI family zinc finger 2
  ENST ID: ENST00000314490
  CDS Start-End: 383-1951
tgggtcggcgtttcccggctgggtttgggctcagtgttggtgagtgtctttgtcttctcttttaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgctggacacggctcatgtgggtgtgcccttcccctctcccgagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggacaccaagctgcctccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgacccc

SEQ ID NO: 137070 - DNA, 4904 bp, Homo sapiens
  Payload ID: 6837
  Gene Symbol: GLI2
  Gene Name: GLI family zinc finger 2
  ENST ID: ENST00000341310
  CDS Start-End: 187-390
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 137071 - DNA, 6768 bp, Homo sapiens
  Payload ID: 6837
  Gene Symbol: GLI2
  Gene Name: GLI family zinc finger 2
  Uniprot ID: P10070
  ENST ID: ENST00000361492
  CDS Start-End: 31-4791
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggc

SEQ ID NO: 137072 - DNA, 6799 bp, Homo sapiens
  Payload ID: 6837
  Gene Symbol: GLI2
  Gene Name: GLI family zinc finger 2
  Uniprot ID: P10070
  ENST ID: ENST00000452319
  CDS Start-End: 61-4821
tgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggca

SEQ ID NO: 137073 - DNA, 4955 bp, Homo sapiens
  Payload ID: 6837
  Gene Symbol: GLI2
  Gene Name: GLI family zinc finger 2
  ENST ID: ENST00000445186
  CDS Start-End: 187-390
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 137074 - DNA, 315 bp, Homo sapiens
  Payload ID: 6837
  Gene Symbol: GLI2
  Gene Name: GLI family zinc finger 2
  ENST ID: ENST00000418323
  CDS Start-End: 70-315
ggccacctgcgtgctagaggcaaacttttgtctctctcggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggt

SEQ ID NO: 137075 - DNA, 3724 bp, Homo sapiens
  Payload ID: 6837
  Gene Symbol: GLI2
  Gene Name: GLI family zinc finger 2
  ENST ID: ENST00000438299
  CDS Start-End: 187-390
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 137076 - DNA, 1112 bp, Homo sapiens
  Payload ID: 6837
  Gene Symbol: GLI2
  Gene Name: GLI family zinc finger 2
  ENST ID: ENST00000433812
  CDS Start-End: 1-171
gcctccgagaagcaagaagccaaaagtgggatcctggaggccgctggcttccccgacccgggtaaaaaggcctctcctttggtggtggctgcagcggcagcagcagcggtagctgcccaaggaggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgag

SEQ ID NO: 137077 - DNA, 3673 bp, Homo sapiens
  Payload ID: 6837
  Gene Symbol: GLI2
  Gene Name: GLI family zinc finger 2
  ENST ID: ENST00000452692
  CDS Start-End: 187-390
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 137078 - DNA, 1904 bp, Homo sapiens
  Payload ID: 6837
  Gene Symbol: GLI2
  Gene Name: GLI family zinc finger 2
  ENST ID: ENST00000437950
  CDS Start-End: 31-234
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgacccc

SEQ ID NO: 137079 - DNA, 529 bp, Homo sapiens
  Payload ID: 6837
  Gene Symbol: GLI2
  Gene Name: GLI family zinc finger 2
  ENST ID: ENST00000360874
  CDS Start-End: 1-529
gcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacggtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacacca

SEQ ID NO: 137080 - DNA, 8208 bp, Homo sapiens
  Payload ID: 6838
  Gene Symbol: GLI3
  Gene Name: GLI family zinc finger 3
  Uniprot ID: P10071
  ENST ID: ENST00000395925
  CDS Start-End: 86-4828
gtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaa

SEQ ID NO: 137081 - DNA, 653 bp, Homo sapiens
  Payload ID: 6838
  Gene Symbol: GLI3
  Gene Name: GLI family zinc finger 3
  ENST ID: ENST00000448703
  CDS Start-End: 114-653
tgcggttctcttgctcgctttctgttctcttgcttactttcaaatgcagacgtgcactacagcgtcaccagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccgg

SEQ ID NO: 137082 - DNA, 451 bp, Homo sapiens
  Payload ID: 6838
  Gene Symbol: GLI3
  Gene Name: GLI family zinc finger 3
  ENST ID: ENST00000437480
  CDS Start-End: 132-422
gcggccgcgcggagcggggagccgccagcctgcgccccgtccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatggcaaccatttggaggcccaggccagaggctggaccaggaggattggatgcatccgcgctgtccatccctgctgctgcacaaacgactcagccacagatcctcttggatgggctaccttgaaagggggaagctccaaagaatgcgtacaaacccatacatttacctaggtgcgggatgattgcaagaccactttatt

SEQ ID NO: 137083 - DNA, 1012 bp, Homo sapiens
  Payload ID: 6839
  Gene Symbol: GLI4
  Gene Name: GLI family zinc finger 4
  ENST ID: ENST00000344692
  CDS Start-End: 40-270
aggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccggtgagtgagcagaatcgggttactgggggaccagagctctgcgcgtgccaggctcctcacaatgcccacctctgtggcacccccaatgctggcaccacccccttcctggggccccttttcttccctggcatcagctcacctctgccccgtggcccctcccccactctaatgccagtccagttactgatgcttcccgaggcggtgactgcagcccacagccacctgcgccagtggccccacgtggactcctgccggccccagctggacacagtgaatcaggaactcctccctcccctccacctgccttgggctggggcttctggctcagggcaccactgtccccccagatccacgagttatcctgtgtcccctcctcctcctgcatcccctagatggcctcccctcagcctggttggagctgtgtccaggtcccctgcacctcccccttgagaagctcccagggttccctctgggcgatgttagtgatatggctggatttaacagtgctgagccctcgcccacatctgggcggccctggggtggggagcaggtgtctgaggtcaggtccctggaaagagaccctgggccagagatttgcgtgggaagctcctggggtgggcatgggagctgggcggcagcacacttgccaccgaggcctggggcagccccatgaggagctgtgcccatatggaccacatcctcggcaagggctttgaggcgccctctggagctctggcgtcccccaggctc

SEQ ID NO: 137084 - DNA, 1341 bp, Homo sapiens
  Payload ID: 6839
  Gene Symbol: GLI4
  Gene Name: GLI family zinc finger 4
  Uniprot ID: P10075
  ENST ID: ENST00000340042
  CDS Start-End: 86-1216
ggccggacacttccgtccggcgcgcggcgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttgg

SEQ ID NO: 137085 - DNA, 361 bp, Homo sapiens
  Payload ID: 6839
  Gene Symbol: GLI4
  Gene Name: GLI family zinc finger 4
  ENST ID: ENST00000520021
  CDS Start-End: 28-361
tgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgatggcctcccctcagcctggttggagctgtgtccaggtcccctgcacctcccccttgagaagctcccagggttccctctgggcgatgttagtgatatggctggatttaaca

SEQ ID NO: 137086 - DNA, 963 bp, Homo sapiens
  Payload ID: 6839
  Gene Symbol: GLI4
  Gene Name: GLI family zinc finger 4
  ENST ID: ENST00000517468
  CDS Start-End: 40-210
aggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatgccctaaggtgctctcccagccgtccgacctggatctccaagacgtagaggaagtggagatcggcagagacaccttctggcccgtccagttactgatgcttcccgaggcggtgactgcagcccacagccacctgcgccagtggccccacgtggactcctgccggccccagctggacacagtgaatcaggaactcctccctcccctccacctgccttgggctggggcttctggctcagggcaccactgtccccccagatccacgagttatcctgtgtcccctcctcctcctgcatcccctagatggcctcccctcagcctggttggagctgtgtccaggtcccctgcacctcccccttgagaagctcccagggttccctctgggcgatgttagtgatatggctggatttaacagtgctgagccctcgcccacatctgggcggccctggggtggggagcaggtgtctgaggtcaggtccctggaaagagaccctgggccagagatttgcgtgggaagctcctggggtgggcatgggagctgggcggcagcacacttgccaccgaggcctggggcagccccatgaggagctgtgcccatatggaccacatcctcggcaagggctttgaggcgccctctggagctctggcgtcccccaggctccgggtcctcaccaacacttagtgcttcctcctggctaagggtgaccccatggtctgtcttgccactgtggctccgtgcaccggcacggccgccgtggtgactgtggatggtcccagcagctctgggtcaccctgcaacgccc

SEQ ID NO: 137087 - DNA, 563 bp, Homo sapiens
  Payload ID: 6839
  Gene Symbol: GLI4
  Gene Name: GLI family zinc finger 4
  ENST ID: ENST00000517530
  CDS Start-End: 1-261
acacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgc

SEQ ID NO: 137088 - DNA, 1082 bp, Homo sapiens
  Payload ID: 6839
  Gene Symbol: GLI4
  Gene Name: GLI family zinc finger 4
  ENST ID: ENST00000521682
  CDS Start-End: 86-583
ggccggacacttccgtccggcgcgcggcgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgtccagttactgatgcttcccgaggcggtgactgcagcccacagccacctgcgccagtggccccacgtggactcctgccggccccagctggacacagtgaatcaggaactcctccctcccctccacctgccttgggctggggcttctggctcagggcaccactgtccccccagatccacgagttatcctgtgtcccctcctcctcctgcatcccctagatggcctcccctcagcctggttggagctgtgtccaggtcccctgcacctcccccttgagaagctcccagggttccctctgggcgatgttagtgatatggctggatttaacagtgctgagccctcgcccacatctgggcggccctggggtggggagcaggtgtctgaggtcaggtccctggaaagagaccctgggccagagatttgcgtgggaagctcctggggtgggcatgggagctgggcggcagcacacttgccaccgaggcctggggcagccccatgaggagctgtgcccatatggaccacatcctcggcaagggctttgaggcgccctctggagctctggcgtcccccaggctccgggtcctcaccaacacttagtgcttcctcctggctaagggtgaccccatggtctgtcttgccactgtggctccgtgcaccggcacggccgccgtggtgactgtggatggtcccagcagctctgggtcaccctgcaacgccccccacccctgtgtctatgtcagctctcctgggcacggcactccgagcccctgtccgc

SEQ ID NO: 137089 - DNA, 1297 bp, Homo sapiens
  Payload ID: 6839
  Gene Symbol: GLI4
  Gene Name: GLI family zinc finger 4
  Uniprot ID: P10075
  ENST ID: ENST00000523522
  CDS Start-End: 40-1170
aggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaa

SEQ ID NO: 137090 - DNA, 5877 bp, Homo sapiens
  Payload ID: 6840
  Gene Symbol: GLIPR1
  Gene Name: GLI pathogenesis-related 1
  Uniprot ID: P48060
  ENST ID: ENST00000266659
  CDS Start-End: 202-1002
agaacacaaagtgagctgcacaccatatatggagaaacccgtttcttaaaactagtgatgaactcatgctctgttctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacttatataccactttctcgtataaatttttcaaaaaatacaataataatataatttataaagaacactcttctatgaacaaccaccaccaccaaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgtatttatagttaaataattcaagtatctatgaactttgctattcatgtgagccagacataaagtgccgtacctttattgcttccattttctgccgcttcttctgatttgccttcaaaaagtattcaccactagccaattctttatcgatctgttgaaaacggtatttacaattacatcagaaataatgtagaggagaagtcatgtcctaagcaagtcacaatatccttagggtaaaaacaatggggtcaaactgatttattaataaaaatggtagtgacataaaggaaacagagtctaagctgaggggaatacatacacaaaagtgtggaggtaggaaagcacctccatggaatacaacccagagtagttcagggatatggcatggaaggtcactgattcagaaaagtgtgagaagaaactggagagagagttttggggaaaatttgaagaagcttcaatggcagacaaagtaggagggataagatttagaaatgactgtaggtttctgagaagactgtaaagaccaaagaataattttaatggagaggaatgaagaatagatgagagcctggaataaaggtagtggcatgcagaataaaagccagaactatcaggaattggtgactaattagcaaaagcaacagcttgttcattcaatatacagccaacatgtaaaatgtgtataactgacctgtctcccacttacatagcattattatatctaaggcactgttctaagctctttataattactcatttaatcctcactaacaattctttaagataggtattaccattactcccactttaggtatggggaaacttaagtatggatgggataaataactcgcccagtcacataatgaattaagtgttaagaacaagtcaatcgagacatcactgtttcaagaagcttacacagctacagaagaaagataagtcaattactacaagaaagggccataagaaataaggcaggtgttatggaagcatggtttaatgactgcatcactccactttccccctaactactatcaatttcctccatgatccaaaacttccattgttttttcactatgatcatcattttccccgtcaatcacaaatcttccctgaaagactccaaccatggttgtggaaaaaagagatgtagaaagcaatgagttcacatgctgagcagaagtagaaagggaaggctttaggatatagccaaggaagggaataatgaagcaagaacccccaggagacaggtgaagatggaattcaaagaacacatagaagaggctgatgcaggtggaagaaaacccatacgtgagagaagaggaaacagaaaggggttcttatctggtggtctcaaatatttcaataaaatgcaatgtcatatgctaaacatgggagggcactgagagaattaagaggaaacatgaattttgaatgaaattaatccaaagataaaactttctctaacttaatttggtagccacgttgcaaggaagaagtcaagtttttagactgatccaagttttagagctttgctgagaaggtgggacagaagtaaaaaggggcatgaatcaaaacaatgatgtgcaagaacaaaatggaaactggtcatggtgggaaaggaaatgaagcagaagacacctgacaaaaggaatcataacttagaaaaacggtgggtgttacaatttacaatttaagatttcagaacaagaacaaccatagagcacacagtcacaataatgttgccaaatcagagaaaagagtattgcagactaaacgaacttttatccatggaacatttacagtggctacagggtcacaaacctcctggatgcagtttataatcaatgtgaacgccccactgcacacccccatgcactcagctcaaaatatgcctatttatatttaccctcagtttcttatagctctgcacacacacacacaatatatatatatacacatatcccacctgaaatactttcaataaagtttctgaccaaa

SEQ ID NO: 137091 - DNA, 714 bp, Homo sapiens
  Payload ID: 6840
  Gene Symbol: GLIPR1
  Gene Name: GLI pathogenesis-related 1
  ENST ID: ENST00000456650
  CDS Start-End: 1-714
atgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggtgtcacaggaaaggggtcgggatccaaaccccaagagagggttcttgaatctcgcgcgagaaaatccagggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtca

SEQ ID NO: 137092 - DNA, 1234 bp, Homo sapiens
  Payload ID: 6840
  Gene Symbol: GLIPR1
  Gene Name: GLI pathogenesis-related 1
  ENST ID: ENST00000536703
  CDS Start-End: 129-575
ttctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcagagggaattacccaacttggccatataagagaggagccacctgcagtgcctgccccaataatgacaagtgtttggacaatctctgtgttaaccgacagcgagaccaagtcaaacgtacgtacatcaatcttaaattgtttcattaagagctatgtgaattctgtcagtgcattatgaggaacaatgtctaagaggatattctatgtttgtttcacaggttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtag

SEQ ID NO: 137093 - DNA, 667 bp, Homo sapiens
  Payload ID: 6840
  Gene Symbol: GLIPR1
  Gene Name: GLI pathogenesis-related 1
  ENST ID: ENST00000550491
  CDS Start-End: 401-667
atccagtttagctctgtctacccaactgttgttataagcaagtgccacagcacattttacttctctttggacacttcctgttttctggttttcagtggattttacttctctttttgttatcttcctccctgttaatttttgtgatttggttttctttttttttttttttttttgtctctaaatttactttttttgctgctgacaaagtactgagttgctcagacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtg

SEQ ID NO: 137094 - DNA, 1132 bp, Homo sapiens
  Payload ID: 6841
  Gene Symbol: GLIPR1L1
  Gene Name: GLI pathogenesis-related 1 like 1
  Uniprot ID: Q6UWM5
  ENST ID: ENST00000312442
  CDS Start-End: 47-748
ctggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataacttatcatcactttgcttctttactgaatcttctacactcttgcctgatacctaaatttaatgtttgtttttaactcaaaaaatgtactgtagtatggaaaatggatagcagtagaataaagtcttaagattattttttaattacaaatccatatgtgtatcaaaagtgttccactctttaattttctaatgagaatggattatcattttagttatagtacatttagagaactaaagacttttcacatatcaaatagtttccttagataccaatagtttcctttatgaataccatcaacatcattcagaaacaaaatg

SEQ ID NO: 137095 - DNA, 885 bp, Homo sapiens
  Payload ID: 6841
  Gene Symbol: GLIPR1L1
  Gene Name: GLI pathogenesis-related 1 like 1
  Uniprot ID: Q6UWM5
  ENST ID: ENST00000378695
  CDS Start-End: 91-819
gcgtggtgcgggggcgtggggaaatcgggttgccccagccgttactggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaggactccacaacttattatacctaaccaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataa

SEQ ID NO: 137096 - DNA, 404 bp, Homo sapiens
  Payload ID: 6841
  Gene Symbol: GLIPR1L1
  Gene Name: GLI pathogenesis-related 1 like 1
  ENST ID: ENST00000547144
  CDS Start-End: 1-119
cactcagtccccagtcacccaaggggcagcttgcagcttgcagtaacaaaatgtcctttctcttcagagctgaggagggactccacaacttattatacctaaccaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataacttatcatcactttgcttctttactgaatcttctacactcttgcctgatacctaaatttaatgtttgtttttaactcaaaaaatgtactgtagtatggaaaatggatagcagtagaataaagtcttaagattattttttaat

SEQ ID NO: 137097 - DNA, 484 bp, Homo sapiens
  Payload ID: 6841
  Gene Symbol: GLIPR1L1
  Gene Name: GLI pathogenesis-related 1 like 1
  ENST ID: ENST00000548623
  CDS Start-End: 23-196
cagctctatatgcatttcttgaatgagtcttttaaaactaattttgttgagggttccctgtagggccactgcatgtcaaaaggggttaaccacccagacattcccactcagtccccagtcacccaaggggcagcttgcagcttgcagtaacaaaatgtcctttctcttcagagctgaggagaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataacttatcatcactttgcttctttactgaatcttctacactcttgcctgatacctaaatttaatgtttgtttttaactcaaaaaatgtactgtagtatggaaaatggatagcagtagaataaagtcttaagattattttttaattac

SEQ ID NO: 137098 - DNA, 1729 bp, Homo sapiens
  Payload ID: 6842
  Gene Symbol: GLIPR1L2
  Gene Name: GLI pathogenesis-related 1 like 2
  Uniprot ID: Q4G1C9
  ENST ID: ENST00000320460
  CDS Start-End: 9-770
ggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaagataaagaaaataaacatgaaaaaaatgcataatggattggacaagaaaaataagcgattgaacactagttttttatggtcatgttaatattattcctttgatcagaatgctactattatgttatcaaaggatggttgacacagtatcatctttagatttttctaaactgcagagctttttctgttctatcttaaccctattccttcccctgaggacataccagagtgtcagaaagaaagaatgagaactaacagttatacccttaaaaagcttcacagtttatgcccaaacagcagcctgtttgataataactgctttaaaggatagtatattccaaaatatttatgaagtagcatatatttaatacccttttcttttagtttttcctccaaaaagctgaaatctccaaatatttcaaaagtaaaaagtagaaaatatgtttgattacatttttcttttagtttttccaaacatgagagaatatactccaaaagtataactgtagctaaaatatacaatgcttagaggaatatggtaggagataaatttggataataagtaaatagcatattatgttgttttttaattattatactttaagttctggggtacctgtgcagaacgtgcaggtttgttacataggtatatacatgccatggtggtttgctgcacccatgaacccatcatctacattagatatttctcctaagctattcctcccctagccctgaccccctgacaggccccagtgtgtgatgttcttctccctgtgtccatgtgttctcattgttcaactcccacttatgagtgagaacatgcagtgtttggttttctgttcttgtgatagtttgctgagaatgatggtttgcagcttcatccatgtccctgaaaaggaaatgaactcatccttttttatggctgcatagtattccatggtgtatatgtgccacactttctttatccagtctatcattgatgggcatttgggttggttccaagtatttgctattgtgaacagtgctgcaataaacatatgtttgcaggtg

SEQ ID NO: 137099 - DNA, 1903 bp, Homo sapiens
  Payload ID: 6842
  Gene Symbol: GLIPR1L2
  Gene Name: GLI pathogenesis-related 1 like 2
  Uniprot ID: Q4G1C9
  ENST ID: ENST00000378692
  CDS Start-End: 468-1181
cagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgttatggtactgctgtgactccgatggtagcagattcatcattggatttccaaacctctcacccaggactccaagtgcacccctttgaagactttgtcttcactcctgaatgattgattggggatccattgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataattttaattagttgtggtagaggaatctgggtgcttccaaatttatatgataaaataaataaattttttaaaaacta

SEQ ID NO: 137100 - DNA, 509 bp, Homo sapiens
  Payload ID: 6842
  Gene Symbol: GLIPR1L2
  Gene Name: GLI pathogenesis-related 1 like 2
  Uniprot ID: Q4G1C9
  ENST ID: ENST00000547164
  CDS Start-End: 1-507
atggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagaggaacactgacgagaagaccttatgaac

SEQ ID NO: 137101 - DNA, 2609 bp, Homo sapiens
  Payload ID: 6842
  Gene Symbol: GLIPR1L2
  Gene Name: GLI pathogenesis-related 1 like 2
  Uniprot ID: Q4G1C9
  ENST ID: ENST00000550916
  CDS Start-End: 48-1082
tgggacggccagcgcgtgcgcactggcctgtcagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataattttaattagttgtggtagaggaatctgggtgcttccaaatttatatgataaaataaataaattttttaaaaactattaacttgttattcaataggtatagtaaaagttaacagattaataagataactgcttaccactagtaatactaataaatgaactaaataaaaatacctagcataggagatttctttatctataaaataaatggatagcactagatgaccactaagacctcttccatcaatgaatattcatggatcaactttgtaaaggaatcaatagtagttgtgaagtacactaagcaaacacctgagggaaaaacttgattcccatgaaaatattcctgaactcagcaccttatatggcaaaataataaataccttttattactcaattttaaaataggcaaaaagcaatgtataatatttttccaattgccattccatactcagctgtcttattgttgcacacttattagaactcaatgtgactgagatgtgaaaggttgatataattctatttatgacagggacttagggaacttattctaattgagaatcagaggcttaataaacctgaaggtttaagtgaaagaaatgacattgaaagaatcactgcatatctgatgttttcaaataaaacaatctctgttttctggttttgatagaatattgtgttctaaagctatatttctcaatgtgtggttccactgagggaaagaaaaaaaaaaaaacctagcatagccaaatacctcaaatggtataaatgctatgtgtatttactctgttgttctttagttgtatcaatattctgttaaaaacctgttcgaagtagggcaagatgagaattatattaaaaagccctgagctatcctcttgga

SEQ ID NO: 137102 - DNA, 812 bp, Homo sapiens
  Payload ID: 6843
  Gene Symbol: GLIPR2
  Gene Name: GLI pathogenesis-related 2
  ENST ID: ENST00000377959
  CDS Start-End: 38-424
cgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtga

SEQ ID NO: 137103 - DNA, 1890 bp, Homo sapiens
  Payload ID: 6843
  Gene Symbol: GLIPR2
  Gene Name: GLI pathogenesis-related 2
  Uniprot ID: Q9H4G4
  ENST ID: ENST00000377960
  CDS Start-End: 35-499
agccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 137104 - DNA, 1917 bp, Homo sapiens
  Payload ID: 6843
  Gene Symbol: GLIPR2
  Gene Name: GLI pathogenesis-related 2
  ENST ID: ENST00000396613
  CDS Start-End: 244-432
cggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcgcagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 137105 - DNA, 1645 bp, Homo sapiens
  Payload ID: 6843
  Gene Symbol: GLIPR2
  Gene Name: GLI pathogenesis-related 2
  ENST ID: ENST00000619700
  CDS Start-End: 36-254
aagtcaggtgagcccgcgggctcgcccgctgcggaatggttcggaaccccgcgctcccggacctcgccgtctccctcgtccgccgcaagccaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 137106 - DNA, 4301 bp, Homo sapiens
  Payload ID: 6844
  Gene Symbol: GMFB
  Gene Name: glia maturation factor, beta
  Uniprot ID: P60983
  ENST ID: ENST00000358056
  CDS Start-End: 270-698
acttgcagccaggcagagcgtcctcctctagagggagcagggaaaagaaaaaaaaaaaaaaaaaaaaaaaaaaaaaaatcaggcgatcgcattctgtctaattttgagccgcgccttttgccgtccgccatcacgtgccggcccgctgaggccgcgttgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaaga

SEQ ID NO: 137107 - DNA, 605 bp, Homo sapiens
  Payload ID: 6844
  Gene Symbol: GMFB
  Gene Name: glia maturation factor, beta
  ENST ID: ENST00000554247
  CDS Start-End: 54-170
attcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataaggcatttcaccagatgaacttaaagatgaactacctgaacgacaacctcgatatccttttcttagtgctttaaaagatttattttctttagtggtcagacctgtttgtgagctcatttgttaaacatctaaaattataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttg

SEQ ID NO: 137108 - DNA, 591 bp, Homo sapiens
  Payload ID: 6844
  Gene Symbol: GMFB
  Gene Name: glia maturation factor, beta
  ENST ID: ENST00000553333
  CDS Start-End: 142-591
ggggaggccccacgccaggtccttctggttggagggcttcagcttctgagctttctgatgacattgcacattattatgtgtgtggtttttgagacattcattagccaaagagaaagttaaaatataccttacatatatgagatgaacaaatttgtaggattaagcaatgtagatccaaagagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgaaccttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaa

SEQ ID NO: 137109 - DNA, 6721 bp, Homo sapiens
  Payload ID: 6844
  Gene Symbol: GMFB
  Gene Name: glia maturation factor, beta
  ENST ID: ENST00000554908
  CDS Start-End: 99-215
gactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataaggcatttcaccagatgaacttaaagatgaactacctgaacgacaacctcgcttcattgtgtatagttataaatatcaacatgatgatggaagagtttcatatcctctgtgctttattttctccagtcctgttggtaagtgaatttctttaaataacacatatttggcttagatccaattaagccattttatactagacaaattttctgctgtttttaaagatgaacattgttgaataacctaaattgaggagggtctgtgtctatgtgtgtccatgtgcctgtgtgcatgcatccctagaaagaatgaagcatcatctcttagaacttattttcttaggataaatttctagacgtgtaattgttgactcaaatcatacatgtattttaaggattttgaaacgtgatgacattctaatatagcagaagtattttctttttatattttaatcatataaaaatgtgaacttcacatataattgcatatatttgtgtttcttttaaatagtagttaacagtgatatgcttataatcttgagaatggtcctagagtaatttacattgggtattaaaatgggttactggtatttaaggaattcattatcaccagaacttctatcaccactgttcaggcctgcaataaaaactgcattcactgagctattctccaaacttcataatttgtataatttacttcccactcaaaatatactgcagtatatttttaacttaatatatcggcagagtgaaacttttatcagagcagatctccctgccctactggtccactaccatcccaaaaccttgtgtattttagtcatccataaaattgatcttgatatttagtgtcaaagttaagatagtgcagaaagtttttaattgtttgcaaggctctaaaagtcaggatctacaaatgtctagaatctttatttttgccaacctgtagacttgttcttgtttatttataacttaactgtctctttctgtaggcagtgtgcaatgtaagactcaaaatacaacccatatatattctgtaaactcaatagcaaaggaaatcctaaatgtgtcattttaaaaaataaaaataatgataacccatacctttctcaaaatctgtgtctcatttctacactaatctctcttttccaggatgtaagcctgaacaacagatgatgtatgctggaagtaagaataagctagtccagacagctgaactaaccaaggtggtatttatatttgactgacttgttgagacaatattttcctttagactataaagcaatagctaaaatagtctaaaggagtattttttatgcaggtgaaggttatttagaccagattagtaagttagccaaagctttttgttaactggaaatagaatgagatagaagcgtttgaaccaaagtgtattttttgaataagttgattggaagaaatcacattcaaaatataggcagtgttagaaagccactgtaactattaaatctattgagagttagtttatctgccataaggtaatttctaatagataagggtcagcattgaagtttctctgaaccctttaccatagtctaaaatgaaccgagttctgtgctggaattcagtattatgcagttaattgtattgtttccaaatataaaattgttaagaatattaataaagttagaacattctgttttatatgagaacttgctttaagatttaacatgtccctattttatggtatttttgaaagttaaaggtaagaggtacttggctctcaaactttatttaacttccacatattagtttgaattgaaaaagtatatgcacttaaggttttgaaataggatattatattgccaaaactgtgttagacagtatttcctttcaagttttattttaagaacagcatcagtattttccccttgggtgcttaataatcaactctggaatgcctttaagtgccctctgctgtttccccttagcccatgtgattgttaccactgctttatagacattactttttcctgatttgtaacacagggacactggagttgctctaacggtttgggtggttaagaaggagctgttaacggcctcaagtctgttctaatcctggggatgccctacagtgctgaagttgagacattacagtttaccagttacttttacagataatctcattgaatccttacaacagccctgtgagatattctgtagataggaaaacagacccagtggatgaatgacttgctcagggttgcataacagtaaatttagacagagctaggatttagctctgtctaggacttaggattcacatctggctccaaatcctatcctttctgctgtaatacattgcttttctatagccgttatgctttctgggcctgattcagattcttgctggagatttgtggctgatctccatctccctctgatatttccatttgacattcagactctggaagaccagcgtatgttcctcagttcctaactagattgattttagttgtgtttacttgggatgtcttctaggagataagatttacagaactgctcttttagactatttgtagatttgtgcttttgggagagttttggtttcatgttgtcttgattgctgtactttggtaactgagtacttagcatttaaaagaagtgaagttctacctaaaaggtatatctcatttacacaggttaagtcatgaacaatatgaaaggaagcagaatttggtatttaatactcaaatatataaccaaaaatagtttggtgtataatactcaaatatattttaaaaaattcaaatatttgactttttttttggagtgtcaaagtatgacccaagttttttttttttttaaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaagac

SEQ ID NO: 137110 - DNA, 4125 bp, Homo sapiens
  Payload ID: 6844
  Gene Symbol: GMFB
  Gene Name: glia maturation factor, beta
  Uniprot ID: P60983
  ENST ID: ENST00000616146
  CDS Start-End: 100-528
cgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgattcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacatt

SEQ ID NO: 137111 - DNA, 639 bp, Homo sapiens
  Payload ID: 6844
  Gene Symbol: GMFB
  Gene Name: glia maturation factor, beta
  ENST ID: ENST00000628554
  CDS Start-End: 31-147
ggcgacaggccgctgacggccggaaggaaaatgagtgagtctttggttgtttgtgatgttgccgaagatttagtggaaaagctgagaaagtttcgttttcgcaaagaaacgaacaacgctgctattataaggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttc

SEQ ID NO: 137112 - DNA, 616 bp, Homo sapiens
  Payload ID: 6845
  Gene Symbol: GMFG
  Gene Name: glia maturation factor, gamma
  ENST ID: ENST00000253054
  CDS Start-End: 175-504
gcctagaagacagcggaactaagaaaagaagaggcctgtggacagaacaatcatgctcttcctgggtccctccggcagtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaa

SEQ ID NO: 137113 - DNA, 397 bp, Homo sapiens
  Payload ID: 6845
  Gene Symbol: GMFG
  Gene Name: glia maturation factor, gamma
  ENST ID: ENST00000594700
  CDS Start-End: 64-285
ccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaa

SEQ ID NO: 137114 - DNA, 487 bp, Homo sapiens
  Payload ID: 6845
  Gene Symbol: GMFG
  Gene Name: glia maturation factor, gamma
  ENST ID: ENST00000595636
  CDS Start-End: 49-288
agaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaat

SEQ ID NO: 137115 - DNA, 490 bp, Homo sapiens
  Payload ID: 6845
  Gene Symbol: GMFG
  Gene Name: glia maturation factor, gamma
  ENST ID: ENST00000596583
  CDS Start-End: 1-180
tctgactccctggtggtgtgcgaggtagacccagagctaacagaaaagctgaggaaattccgcttccgaaaagagacagacaatgcagccatcataaaacatttccccagaggagctcaaaatggagttgccggagagacagcccaggttcgtggtttacagctacaagtacgtgcatgacgatggccgagtgtcctaccctttgtgtttcatcttctccagccctgctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgga

SEQ ID NO: 137116 - DNA, 405 bp, Homo sapiens
  Payload ID: 6845
  Gene Symbol: GMFG
  Gene Name: glia maturation factor, gamma
  ENST ID: ENST00000601731
  CDS Start-End: 62-97
ggtccccacgcctagaagacagcggaactaagaaaagaagaggcctgtggacagaacaatcatggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaa

SEQ ID NO: 137117 - DNA, 423 bp, Homo sapiens
  Payload ID: 6845
  Gene Symbol: GMFG
  Gene Name: glia maturation factor, gamma
  ENST ID: ENST00000602185
  CDS Start-End: 30-311
aaaagaagaggcctgtggacagaacaatcatgaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaa

SEQ ID NO: 137118 - DNA, 1028 bp, Homo sapiens
  Payload ID: 6845
  Gene Symbol: GMFG
  Gene Name: glia maturation factor, gamma
  ENST ID: ENST00000598034
  CDS Start-End: 31-447
gaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggttcagactgggatggggctccagagtgttagggagaggtggtgtgggtcctgggtctgagggaagagggactagagtcctcactgtctcagtggtttttgtttttgtttttgtttttttaaagaactgggtctcgctctgtcatccaggctggagtgcagtggcacaacctcggctcactgcaacctcctcctcctgggttcaagcaattctcctgcctcagcctcccaagtagtgggacgacaggcacacgccaccacacctggctactttttgtatttttagtagagtcagggtttcaccatattggccaggctggtctcgaactcctgaccttaagtgatccacccacctcagcctcccaaagtgctctcttacaggtgagccaccgtgcccagccactgtctcagtgtttgagtagatcataatgccgagacctctctctgcccaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgga

SEQ ID NO: 137119 - DNA, 622 bp, Homo sapiens
  Payload ID: 6845
  Gene Symbol: GMFG
  Gene Name: glia maturation factor, gamma
  ENST ID: ENST00000600322
  CDS Start-End: 178-507
attagctcacgcccgggtgacgaacggcgcgccagccaacgggcggcgagggcagcccgaagggcgggaggtgtgagccgatctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactc

SEQ ID NO: 137120 - DNA, 497 bp, Homo sapiens
  Payload ID: 6845
  Gene Symbol: GMFG
  Gene Name: glia maturation factor, gamma
  ENST ID: ENST00000601387
  CDS Start-End: 68-373
agcggaactaagaaaagaagaggcctgtggacagaacaatcatgtgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcggagatcct

SEQ ID NO: 137121 - DNA, 758 bp, Homo sapiens
  Payload ID: 6845
  Gene Symbol: GMFG
  Gene Name: glia maturation factor, gamma
  Uniprot ID: O60234
  ENST ID: ENST00000597595
  CDS Start-End: 210-638
gagcgatttcctgacaggtcctggcagatgaggggaaggaaggagggggaggagccctctgtgacagttgtcccagaaagggcataaacaggatgtggtgttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcggaga

SEQ ID NO: 137122 - DNA, 526 bp, Homo sapiens
  Payload ID: 6845
  Gene Symbol: GMFG
  Gene Name: glia maturation factor, gamma
  ENST ID: ENST00000595207
  CDS Start-End: 30-212
aaaagaagaggcctgtggacagaacaatcatgtctgactccctggtggtgtgcgaggtagacccagagctaacagaaaagctgaggaaattccgcttccgaaaagagacagacaatgcagccatcataaaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgga

SEQ ID NO: 137123 - DNA, 3810 bp, Homo sapiens
  Payload ID: 6846
  Gene Symbol: GDNF
  Gene Name: glial cell derived neurotrophic factor
  Uniprot ID: P39905
  ENST ID: ENST00000326524
  CDS Start-End: 201-836
ccgcctccagcgcgcccttgctgccccgcgcgaccccaggattgcgaactcttgcccctgacctgttgggcggggctccgcgctccagccatcagcccggatgggtctcctggctgggacttggggcacctggagttaatgtccaacctagggtctgcggagacccgatccgaggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 137124 - DNA, 3655 bp, Homo sapiens
  Payload ID: 6846
  Gene Symbol: GDNF
  Gene Name: glial cell derived neurotrophic factor
  Uniprot ID: P39905
  ENST ID: ENST00000344622
  CDS Start-End: 124-681
catacaggccaaaagtctccaagtccctgctaacttcttgctctcgcaacagaatacctatttaggtgggaagaatgaggtgtgggcggcaggctgggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 137125 - DNA, 778 bp, Homo sapiens
  Payload ID: 6846
  Gene Symbol: GDNF
  Gene Name: glial cell derived neurotrophic factor
  Uniprot ID: P39905
  ENST ID: ENST00000381826
  CDS Start-End: 170-778
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 137126 - DNA, 856 bp, Homo sapiens
  Payload ID: 6846
  Gene Symbol: GDNF
  Gene Name: glial cell derived neurotrophic factor
  Uniprot ID: P39905
  ENST ID: ENST00000427982
  CDS Start-End: 170-856
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 137127 - DNA, 306 bp, Homo sapiens
  Payload ID: 6846
  Gene Symbol: GDNF
  Gene Name: glial cell derived neurotrophic factor
  ENST ID: ENST00000502572
  CDS Start-End: 124-306
catacaggccaaaagtctccaagtccctgctaacttcttgctctcgcaacagaatacctatttaggtgggaagaatgaggtgtgggcggcaggctgggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcct

SEQ ID NO: 137128 - DNA, 295 bp, Homo sapiens
  Payload ID: 6846
  Gene Symbol: GDNF
  Gene Name: glial cell derived neurotrophic factor
  ENST ID: ENST00000510177
  CDS Start-End: 113-295
tggagaggggcgcagggacccgcagggagcccaggcttaacgtgcattctgcggttctctcccccacctcccgcctgcccgcgcaggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcct

SEQ ID NO: 137129 - DNA, 764 bp, Homo sapiens
  Payload ID: 6846
  Gene Symbol: GDNF
  Gene Name: glial cell derived neurotrophic factor
  Uniprot ID: P39905
  ENST ID: ENST00000515058
  CDS Start-End: 207-764
tggccgccgcctccagcgcgcccttgctgccccgcgcgaccccaggattgcgaactcttgcccctgacctgttgggcggggctccgcgctccagccatcagcccggatgggtctcctggctgggacttggggcacctggagttaatgtccaacctagggtctgcggagacccgatccgaggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 137130 - DNA, 3638 bp, Homo sapiens
  Payload ID: 6846
  Gene Symbol: GDNF
  Gene Name: glial cell derived neurotrophic factor
  Uniprot ID: P39905
  ENST ID: ENST00000620847
  CDS Start-End: 185-664
gtgccgccgccggacgggactttaagatgaagttatgggatgtcgtggctgtctgcctggtgctgctccacaccgcgtccgccttcccgctgcccgccgggcacaggaagatgacttgatgatttaagagaagattgatgacggtcatttcaaatgtagccgagacattcagccaagagcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 137131 - DNA, 2765 bp, Homo sapiens
  Payload ID: 6847
  Gene Symbol: GCM1
  Gene Name: glial cells missing homolog 1 (Drosophila)
  Uniprot ID: Q9NP62
  ENST ID: ENST00000259803
  CDS Start-End: 213-1523
gagcctgctgggacttgaaccagcagtaagattttcacgacacagtgctgtctgcttctccgtaagaagttagaagccctagaaaacaatctcctggtccaaggtgcttgagtgggccgatccagctatatcaagaacctttgagaacaaaattctcaagcatttctgaggggagtcgaataggtgaaaaccttggctggcctgaccttatcatggaacctgacgactttgattctgaagacaaagagatattaagctgggatattaatgatgtgaaactgccacagaacgtgaaaaaaaccgactggttccaggagtggccagattcctatgccaaacacatctacagctcggaggacaagaatgcgcagcggcacctgagcagctgggccatgcgcaataccaacaaccacaactcccgcatcctcaagaagtcctgcctgggtgtggtggtgtgcggccgcgactgtctcgcagaggaggggcgcaagatctacctgagacctgccatctgtgacaaggcccggcagaagcagcagcggaaacgctgtcccaactgtgacgggcctctgaagctcatcccttgccgaggtcatgggggcttcccggtcaccaacttctggaggcacgacggacgctttatatttttccagtcaaagggagagcatgatcatccaaaaccagaaaccaagttagaagctgaggcaagaagagccatgaagaaagtgaacacagcaccttcctccgtctcattgagcctgaaggggagcacagagaccaggtctcttccaggtgaaacacaaagtcaggggagtttacctttaacttggtctttccaggaaggcgtccaattgcctggtagttacagtggacatttaatagctaacactcctcagcagaactcactaaatgattgcttttccttctccaagagttatggtctgggaggaatcacagatctgactgaccagacttccactgtggaccccatgaagctctatgaaaagcgcaaattgtccagtagcagaacctacagtagtggagacctgcttcctccttctgcctccggagtctactctgatcatggcgatctacaagcgtggagtaaaaatgctgctttggggagaaatcatcttgctgacaactgttattccaattatccttttcctctgaccagctggccttgcagcttctctccttcccaaaactcttcagaacccttttaccagcagcttccattggagccacctgcagccaaaactggctgtcccccattatggccaaatccagcgggtaatctttatgaagagaaagtacatgtggattttaacagctacgtccagtctcctgcataccattcacctcaagaagacccctttctcttcacctacgcctctcatcctcatcagcaatattcactgccaagcaagagcagcaaatgggattttgaggaagaaatgacatacttgggtttggatcactgcaacaatgatatgcttctgaacctgtgtcctttgagatgacccaaatctttcactatgtgcaccccagcccctcaaaaatggggaagggctgaaagaatttccttaggaaataatttttaaaacataaccacagataaatgagaatcatgataagcagtagacaaggcttttttctttttcttttttccttctttttttttttttttttttttttttgagacagagtcttgctcttttgcccaggcaggaatgcagtggcgccatctcggctcactgcaacctctgcctcccgggtttgagtgattctcctgcgtcagcctcccgagtagctgggattacaggcacctgccactgcgcctggctaatttttctatttttagtagagacagggttttgccatgttggtcaggctgctctcaaactcctgatctcaagtgatctgcccacctcaccatcccaaagtgctgggattacaggcgtgagccattgtgcccggctgacaaggcttttttcttcacatgagtaatttttttggcttcttctcctccactctagtatttccaccctcagtaaggaatggaaacctgtcccgtctggggtgtgaagtgccctctgctttttcccccacattgtttggggttcccagcacctcagccacattgcatgctgggttttcattgtcattgttgcaaatgaaatggagtagacatgtgaaatgctaacctatctaggacctgatctatgccttcttgggaactgagaatgaagaaacagaaatagatggtggaagaactgcctaaggtgtgaaaagctgaagattctaccactgaagtactgaatatgttgtctagttgtgagactagtgtgtaaaatatatgttttctagatgatttctgagacttgtgatgacaaggaacctgacctaaccccatttttcataaagacaaagaacagcaatgttaaattgccatatgaagagaaacactagtgatgtgcgtggtctccttgcctcttgtttccttccctcttcctcactgacttccccttgcacaggggcttctgttttatcccatttattatttgtggcacctatatcaatgtggggtttgtaataggtgagaaatatttgcttggagaagctcttgtgcaattagcctggcaatgattggccggccatgtttgaatgccagtttctcttctttgctgaagtactttatgataaaagtaagcctagacataaaatctggagagaaccatgcaataaacaagtatttttgaaat

SEQ ID NO: 137132 - DNA, 2441 bp, Homo sapiens
  Payload ID: 6848
  Gene Symbol: GCM2
  Gene Name: glial cells missing homolog 2 (Drosophila)
  Uniprot ID: O75603
  ENST ID: ENST00000379491
  CDS Start-End: 149-1669
cctctctctctttctctctctctgcacctccccttcacacaccccactttcttctttaaagagaagaaaaaaaacccacctggcgcacctgtccttttttcttctatttttcagaaccctgggcggaaagcgcgagcgagttgggcagatgccggcggccgcggtgcaggaagcggtcggcgtgtgctcctacgggatgcagctcagctgggacatcaacgatccgcagatgcctcaggagctggccctctttgaccaattccgagagtggcctgacggctatgtgcgcttcatctacagcagcgatgagaagaaggcacagcgtcacctgagcggctgggccatgcgcaacaccaacaaccacaatggccacatcctcaagaagtcgtgcctgggtgtggtggtgtgtacacaggcctgcaccctgcccgacggttcccgcctgcagctgaggccggccatctgcgacaaggcacggctgaaacagcagaagaaggcatgccctaactgtcattctgctttggagttgattccttgtcgagggcacagcggataccccgtaaccaacttttggcggcttgatggcaacgcgatcttttttcaggccaagggagttcatgatcatccaagaccagagagcaaatcagagacagaagctagaagaagcgccatcaagagacaaatggcctctttctaccaaccccagaaaaagagaattcgagaatccgaggcagaagaaaatcaagacagcagtggtcatttcagcaacatacctcccttggaaaatccagaagactttgatatagttactgaaaccagcttccctattccagggcagccttgcccttccttcccaaagtctgatgtttacaaagctacctgtgacctagccacctttcaaggagacaaaatgccacccttccagaaatactcaagcccaagaatctatttgcctaggccaccttgcagctatgaattggcaaaccctggttatacaaattcaagcccatatcccaccctttataaggattccaccagtatccctaatgacacagactgggttcatctgaacacactacaatgtaatgtcaattcatacagcagctatgagagaagctttgatttcaccaacaaacagcatggctggaaaccagctcttggaaaacccagccttgtggaaaggactaaccatgggcagtttcaggccatggccactcgcccttattataacccagagcttccctgcaggtacctcacgactccaccaccaggtgcccctgccctacaaaccgtgatcaccaccaccactaaagtgtcctaccaggcctaccagccccctgctatgaaatacagtgacagtgtgcgagaggtgaagagcctttcgagctgtaactatgctcctgaagatactgggatgtctgtctatccagaaccctggggtcctccggtgacagtcaccagggcagcctctccttcagggccacctcctatgaaaattgcaggagattgccgggccatcagacccactgtggctattccccacgagccagtttcctctaggacagatgaagcagagacttgggatgtgtgtctgtctgggctgggctccgcagtcagttactcagacagagtgggtcccttctttacctacaacaatgaggatttttgaaagacaatccaggggacataatagcagtgtgcatgcaggcaggaggcagggaaatgtgaaatggcaatgatctcttattgagttgggagattcaccttgtgtgcaaagaaacacagatagtagtaaaaattctgagtaactgagaaaataatcagttggaaatgattagataatatgggaaatttcacacagcattttgaaactggctacaatacatagaagtagtgaggaaagtgtgagtctctcaaatgaacaaataagcaaactgtaggaggttaaatactgacctaagttcacttagcttattagcaggagtagaagtcaaggattctggttcttattctaggacttttcccattagagcaccttagggaatttcacatccctagaggctgccaaaatagcttcaggaagaaatttttacaatcttatcacctgagtcatttcatgaaatttttgtttagcatttagaacctgttaaactagcttcaggaagtaattttgattgttttatctccaacgtgtgtatctacagcttttcaaaaaatctctagcaatggtaaagttcagttgtttttaaaagattcaatattagcttttcataacatgatagtttcctaaccttttcataaccttttcataacatgatagtttccataacagagacagcctaacaatgatgagttgtatttaatggattaccattgtactaaatacattttttttctgattaggtttcagaattataattaaaatgttttgctgaaataca

SEQ ID NO: 137133 - DNA, 3086 bp, Homo sapiens
  Payload ID: 6849
  Gene Symbol: GFAP
  Gene Name: glial fibrillary acidic protein
  Uniprot ID: P14136
  ENST ID: ENST00000253408
  CDS Start-End: 67-1365
atcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttcccca

SEQ ID NO: 137134 - DNA, 1013 bp, Homo sapiens
  Payload ID: 6849
  Gene Symbol: GFAP
  Gene Name: glial fibrillary acidic protein
  ENST ID: ENST00000376990
  CDS Start-End: 15-554
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctca

SEQ ID NO: 137135 - DNA, 1773 bp, Homo sapiens
  Payload ID: 6849
  Gene Symbol: GFAP
  Gene Name: glial fibrillary acidic protein
  Uniprot ID: P14136
  ENST ID: ENST00000435360
  CDS Start-End: 9-1304
agagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatatta

SEQ ID NO: 137136 - DNA, 524 bp, Homo sapiens
  Payload ID: 6849
  Gene Symbol: GFAP
  Gene Name: glial fibrillary acidic protein
  ENST ID: ENST00000586127
  CDS Start-End: 489-524
gtgtgtgtgtgcaacagtgagtgtatgcttgtggatgcgcctgtgtgagcagaagcaggtgcaccaaccctgataaggcaccttagtaatgagttaaggcaaaagcccacatctgctcatcctccagacaagtcctctgtctaaggccccccaacccttaatcctcctgctgctctactggtcctgggtgggggtggtctctgtgacagctgcctcaagggagactgaggcaggtattcaagtgtcctcagaagagcctggacccaggaatgtgtccccccactccaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccg

SEQ ID NO: 137137 - DNA, 580 bp, Homo sapiens
  Payload ID: 6849
  Gene Symbol: GFAP
  Gene Name: glial fibrillary acidic protein
  ENST ID: ENST00000585728
  CDS Start-End: 15-200
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatgg

SEQ ID NO: 137138 - DNA, 762 bp, Homo sapiens
  Payload ID: 6849
  Gene Symbol: GFAP
  Gene Name: glial fibrillary acidic protein
  ENST ID: ENST00000592320
  CDS Start-End: 19-762
gagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 137139 - DNA, 578 bp, Homo sapiens
  Payload ID: 6849
  Gene Symbol: GFAP
  Gene Name: glial fibrillary acidic protein
  ENST ID: ENST00000588957
  CDS Start-End: 407-578
aaacacagctcactgcagcctcaacctactgggctcaagcaatcctccagcctcagcctcccaaagtgctgggattacaagcatgagccaccccactcagccctttccttcctttttaattgatgcataataattgctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggca

SEQ ID NO: 137140 - DNA, 571 bp, Homo sapiens
  Payload ID: 6849
  Gene Symbol: GFAP
  Gene Name: glial fibrillary acidic protein
  ENST ID: ENST00000587997
  CDS Start-End: 1-571
cacagagattgcaactgagagagggagagacagagacagagaagctgagactgagagagacactcagagagaggagagaaacagagattggcaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacc

SEQ ID NO: 137141 - DNA, 787 bp, Homo sapiens
  Payload ID: 6849
  Gene Symbol: GFAP
  Gene Name: glial fibrillary acidic protein
  ENST ID: ENST00000588316
  CDS Start-End: 3-787
ggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 137142 - DNA, 585 bp, Homo sapiens
  Payload ID: 6849
  Gene Symbol: GFAP
  Gene Name: glial fibrillary acidic protein
  ENST ID: ENST00000588037
  CDS Start-End: 18-585
agcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagaatgtgtccccccactccaggctccaggatgaaaccaacctgaggctggaagccgagaacaacctggctgcctatagacaggaagcagatgaagccaccctggccc

SEQ ID NO: 137143 - DNA, 564 bp, Homo sapiens
  Payload ID: 6849
  Gene Symbol: GFAP
  Gene Name: glial fibrillary acidic protein
  ENST ID: ENST00000588735
  CDS Start-End: 15-191
agagccagagcaggatggagaggagacgcatcacctccgctgctcgccgctcctacgtctcctcaggggagatgatggtggggggcctggctcctggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgcca

SEQ ID NO: 137144 - DNA, 370 bp, Homo sapiens
  Payload ID: 6849
  Gene Symbol: GFAP
  Gene Name: glial fibrillary acidic protein
  ENST ID: ENST00000593179
  CDS Start-End: 345-370
agcacagccccctaggggctgcccttgctgtgtggcgccaccggcggtggagaacaaggctctattcagcctgtgcccaggaaaggggatcaggggatgcccaggcatggacagtgggtggcagggggggagaggagggctgtctgcttcccagaagtccaaggacacaaatgggctggagtggcgcaaacacagctcactgcagcctcaacctactgggctcaagcaatcctccagcctcagcctcccaaagtgctgggattacaagcatgagccaccccactcagccctttccttcctttttaattgatgcataataattgagcgagcagagccagagcaggatggagaggagacgcatcacctccgc

SEQ ID NO: 137145 - DNA, 193 bp, Homo sapiens
  Payload ID: 6849
  Gene Symbol: GFAP
  Gene Name: glial fibrillary acidic protein
  ENST ID: ENST00000586125
  CDS Start-End: 1-193
ttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcgaaaccagcctggacaccaagtctgtgtcagaaggccacctcaagaggaaca

SEQ ID NO: 137146 - DNA, 537 bp, Homo sapiens
  Payload ID: 6849
  Gene Symbol: GFAP
  Gene Name: glial fibrillary acidic protein
  ENST ID: ENST00000591880
  CDS Start-End: 1-306
attcccgtgcagaccttctccaacctgcagattcgagaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgt

SEQ ID NO: 137147 - DNA, 1445 bp, Homo sapiens
  Payload ID: 6849
  Gene Symbol: GFAP
  Gene Name: glial fibrillary acidic protein
  Uniprot ID: P14136
  ENST ID: ENST00000586793
  CDS Start-End: 9-1325
agagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagctt

SEQ ID NO: 137148 - DNA, 1999 bp, Homo sapiens
  Payload ID: 6850
  Gene Symbol: GBAS
  Gene Name: glioblastoma amplified sequence
  Uniprot ID: O75323
  ENST ID: ENST00000322090
  CDS Start-End: 30-890
gggcggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacactgagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacata

SEQ ID NO: 137149 - DNA, 660 bp, Homo sapiens
  Payload ID: 6850
  Gene Symbol: GBAS
  Gene Name: glioblastoma amplified sequence
  ENST ID: ENST00000456204
  CDS Start-End: 5-442
caagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgcagctccctgtttgcagaacataaagacttaactcctgcctggtttttaggggtcccaataatgggattctgcccaacccatccagttctgggtacaagtactgcctgccttacaatctccattcagtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatg

SEQ ID NO: 137150 - DNA, 818 bp, Homo sapiens
  Payload ID: 6850
  Gene Symbol: GBAS
  Gene Name: glioblastoma amplified sequence
  ENST ID: ENST00000437587
  CDS Start-End: 577-818
ggccacatcctccccgcggcgctggcccggcctgcagggccctgaccggcgcgacccgtggccagggacagggacagcgcgcgcctgaggccgcaggccccggacgccgtctgctgggtcctcgccggaggctgttccaagcctgagtggctgcgtctgccgaggacgttggtgaccctggtctctgaggtgccgggagtagggaataaaagagtaaagcattgtcccgggccagctctccgcggagcgacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcgg

SEQ ID NO: 137151 - DNA, 662 bp, Homo sapiens
  Payload ID: 6850
  Gene Symbol: GBAS
  Gene Name: glioblastoma amplified sequence
  ENST ID: ENST00000446692
  CDS Start-End: 467-662
ctttaactccgcccacggctaaggagatgcacggcctacgagaggggtagtgtgggactgagccaatgcgtacggcgtgacgccatcccgctgcgaccggcgctccccggggcaggtggctgcatagtcttggcggaggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattact

SEQ ID NO: 137152 - DNA, 1882 bp, Homo sapiens
  Payload ID: 6850
  Gene Symbol: GBAS
  Gene Name: glioblastoma amplified sequence
  Uniprot ID: O75323
  ENST ID: ENST00000446778
  CDS Start-End: 30-773
gggcggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagttcaagaggtgttgccaaagattcacgaagataaacactacccttgtactttggtggggacttggaacacgtggtatggcgagcaggaccaagctggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacactgagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacata

SEQ ID NO: 137153 - DNA, 872 bp, Homo sapiens
  Payload ID: 6850
  Gene Symbol: GBAS
  Gene Name: glioblastoma amplified sequence
  ENST ID: ENST00000415967
  CDS Start-End: 1-343
tcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactggtaactaagatggtgaccacctcgtctgtacaggcttctgattgttaccaggctaagggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtcc

SEQ ID NO: 137154 - DNA, 5739 bp, Homo sapiens
  Payload ID: 6851
  Gene Symbol: GLTSCR1
  Gene Name: glioma tumor suppressor candidate region gene 1
  Uniprot ID: Q9NZM4
  ENST ID: ENST00000396720
  CDS Start-End: 195-4877
gcgcggccagagcggccggggacaggctccgaggcaggcccgacccgcctccccggcgccgccgtggctcgacggagaccagctaggctggcccccaagaggaccctttccaagtccccagctgggggccctgtgtagacctggagtggacacgcccctccttcccttcatgattcgtttgtagcgcagtggcgatggatgatgaggatgggagatgcttactagacgtgatttgtgacccacaggccctcaatgacttcttgcatggatccgagaagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcctaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacactgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgta

SEQ ID NO: 137155 - DNA, 532 bp, Homo sapiens
  Payload ID: 6851
  Gene Symbol: GLTSCR1
  Gene Name: glioma tumor suppressor candidate region gene 1
  ENST ID: ENST00000594866
  CDS Start-End: 154-532
ggggccgtctcggagaccccgcgccgacggctgctcaaacatcaggctggcccccaagaggaccctttccaagtccccagctgggggccctgtgtagacctggagtggacacgcccctccttcccttcatgattcgtttgtagcgcagtggcgatggatgatgaggatgggagatgcttactagacgtgatttgtgacccacaggccctcaatgacttcttgcatggatccgagaagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgg

SEQ ID NO: 137156 - DNA, 5697 bp, Homo sapiens
  Payload ID: 6851
  Gene Symbol: GLTSCR1
  Gene Name: glioma tumor suppressor candidate region gene 1
  ENST ID: ENST00000614245
  CDS Start-End: 364-4890
ctcgtagctccactctgcagcctcaaactcctgggctccagtgatcctctcacctcagcctcccaagtagctaagaccacaggcacatgctgccacccctgactaatttttcttttttaaaatttttttctcactgcgttgcccaggctggtctcaaactctttggctcaagccatccatcctcctacctcagcctcccaaagtgctgagattacaagcgtgaaccaccatgccaggagggaatgttctttcttgaacgtggctgccctgtcacctcagcattctttgcggcagctgtggcctaagcgtagccccttgctaacctcagctctttccttcccacctttcccggcctgcagctccatgtgcaaggcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcctaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacactgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaat

SEQ ID NO: 137157 - DNA, 1528 bp, Homo sapiens
  Payload ID: 6852
  Gene Symbol: GLTSCR2
  Gene Name: glioma tumor suppressor candidate region gene 2
  Uniprot ID: Q9NZM5
  ENST ID: ENST00000246802
  CDS Start-End: 39-1475
ttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcagaggcggcggcaggcgcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 137158 - DNA, 810 bp, Homo sapiens
  Payload ID: 6852
  Gene Symbol: GLTSCR2
  Gene Name: glioma tumor suppressor candidate region gene 2
  ENST ID: ENST00000595143
  CDS Start-End: 1-797
ggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatgctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtag

SEQ ID NO: 137159 - DNA, 501 bp, Homo sapiens
  Payload ID: 6852
  Gene Symbol: GLTSCR2
  Gene Name: glioma tumor suppressor candidate region gene 2
  ENST ID: ENST00000598959
  CDS Start-End: 1-448
tgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgccgtggaggcgcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 137160 - DNA, 656 bp, Homo sapiens
  Payload ID: 6852
  Gene Symbol: GLTSCR2
  Gene Name: glioma tumor suppressor candidate region gene 2
  ENST ID: ENST00000597985
  CDS Start-End: 1-603
ctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcgcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 137161 - DNA, 303 bp, Homo sapiens
  Payload ID: 6852
  Gene Symbol: GLTSCR2
  Gene Name: glioma tumor suppressor candidate region gene 2
  ENST ID: ENST00000594182
  CDS Start-End: 1-300
gcgcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccactgccatcagatgccggagactcgcccttcaataaaaaatctcttctagctg

SEQ ID NO: 137162 - DNA, 4971 bp, Homo sapiens
  Payload ID: 6853
  Gene Symbol: GLDN
  Gene Name: gliomedin
  Uniprot ID: Q6ZMI3
  ENST ID: ENST00000335449
  CDS Start-End: 57-1712
aaaggctgccagggccgcaggctgccaagccctgccctgcccaaggcgcatagagcatggcccgaggcgctgagggaggccgtggggacgcgggttggggcctgcgtggcgccctggcggccgtggcgctgctctcggcgctcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggcgagcccgcgccgcatatccgcgccgagagccatgacatgctgatgatgatgacctactccatggtgccgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttttttttttttttttttttcaataagctattttttttcttttcttattttaaatagagagagagtcttgctatgtttcccaggctggtcttgaactcctggggctcaagtgatcctcctgccttggcctcccaaaatgctggattacaggcatgtgtgcctggcccaggtttcttaataaaacagaatcatgatcttccaggttccccccagtttctgatcatgttgatttgtagctgtggatcatgaacactgaatcctcagatcactctgacttcttatgcttctcctgtggatccactatcaaagtactaaatgctgtgtaagtagacgttaatctggctggaaccatgggaagcactttgcagtgttcagaagagaggctccatttgtggctattatgtagaactgggccagagccagtccattgcctgtttttttaaataaggttttactgagcacagccacactcatttgtttatgcagtacggcctgacattgcttttgctctgcaacagcagagtcgagtcattgcaacaaagagcatatggccccacagtgcctaaaatattgaccagctacccctttatggaaaaagattgctgactcctgataaagaatataaagtgagcctgattcttgaaaaaatcagaaccagagcctgttttgttttgttctaaactaagaagccgcataggatgtgacttgcgttttgagtagaggggaaggctgataacggcgtaagatgaagtggccctccacaaaggctggttaggggacagttctttctctaacatagttttaaaggatgtgatctggtccccttggatgccaggagagaatccagttgaacttgctcctaaatgctcttaaatatgcatattttctgccaactcacttctttaaacatctttcagcccagcgctgcggccccgggaagggccactgcgaatagagaggaagctggaaaagttcctggggctctgcagccaggaaggggaaccagggcaaatcttatgtaaagatttttcagcaacttgtcccaatttgtgtgtattctgaaactttctctttgggaccaaattcattctcaatggccctgagttcaatatattattaacagcagtattttaaaacttagggttgaactgggcatggtggcacataactgcaatcccagctactttggaggcagggatgggaggatcacttgaggccaggatctcaggaccagcctagagagatcccatctctaaaaaataaaatataagaaaataaaacttaggggatatacagatttaaatattcaaatctccctgctcccctgaaagtccccaggcagctgtcaatgacttgtttgttgtgttctcaatatgatggctatttgaaacttcacctacttttcattagattggttgtaccatgtcaccttagcttttaaaaatactcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcacatgttgaaa
